US006794143B2

(12) United States Patent
Blumenfeld et al.

(10) Patent No.: US 6,794,143 B2
(45) Date of Patent: Sep. 21, 2004

(54) BIALLELIC MARKERS DERIVED FROM GENOMIC REGIONS CARRYING GENES INVOLVED IN ARACHIDONIC ACID METABOLISM

(75) Inventors: Marta Blumenfeld, Paris (FR); Lydie Bougueleret, Vanves (FR); Ilya Chumakov, Vaux-le-Pénil (FR); Annick Cohen, Paris (FR)

(73) Assignee: Genset S.A. (FR)

( * ) Notice: Subject to any disclaimer, the term of this patent is extended or adjusted under 35 U.S.C. 154(b) by 80 days.

(21) Appl. No.: 10/170,097

(22) Filed: Jun. 10, 2002

(65) Prior Publication Data

US 2003/0228582 A1 Dec. 11, 2003

Related U.S. Application Data

(63) Continuation of application No. 09/641,638, filed on Aug. 16, 2000, now Pat. No. 6,432,648, which is a continuation-in-part of application No. 09/502,330, filed on Feb. 11, 2000, now abandoned, and a continuation-in-part of application No. PCT/IB00/00184, filed on Feb. 11, 2000, which is a continuation-in-part of application No. 09/275,267, filed on Mar. 23, 1999, now abandoned.
(60) Provisional application No. 60/133,200, filed on May 7, 1999, and provisional application No. 60/119,917, filed on Feb. 12, 1999.

(51) Int. Cl.[7] .......................... C12Q 1/68; C12P 19/34; C12N 15/11

(52) U.S. Cl. .......................... 435/6; 435/91.2; 536/23.5

(58) Field of Search .................... 435/6, 91.2; 536/23.5

(56) References Cited

U.S. PATENT DOCUMENTS

| | | | |
|---|---|---|---|
| 4,858,127 A | 4/1987 | Mundy | |
| 5,182,367 A | 1/1993 | Gillard et al. | |
| 5,322,770 A | 6/1994 | Gelfand | |
| 6,432,648 B1 * | 8/2002 | Blumenfeld et al. | 435/6 |
| 2002/0103365 A1 | 8/2002 | Baranova et al. | |

FOREIGN PATENT DOCUMENTS

| | | |
|---|---|---|
| EP | 0 684 315 | 11/1995 |
| WO | WO 92/15712 | 8/1992 |
| WO | WO 93/20227 | 10/1993 |
| WO | WO 93/22461 | 11/1993 |
| WO | WO 95/21271 | 8/1995 |
| WO | WO 95/35372 | 12/1995 |
| WO | WO 99/52942 | 10/1996 |
| WO | WO 97/42347 | 11/1997 |

OTHER PUBLICATIONS

Deka et al. Population Genetic Characteristics of the D1S80 locus in seven human populations. Human Genetics vol. 94, pp. 252–258 (1994).*

Ajioka et al., Am. J. Hum. Genet., 80; 1439–1447, 1997, "Hapiotyoe Analysis of Hemochromatosis: Evaluation of Different Linkage–Disequilibrium Approaches and Evolution of Disease Chromosomes."

Altschul et al, Journal of Molecular Biology 215: 403, 1990, "Basic Local Alignment Search Tool."

Bealicage et al., Tetrahedron Letters, 22(20): 1859–1862, 1981, "Deoxynucleoside Phosphoramidites—A New Class of Key Intermediates for Deoxynucleoside Synthesis."

Brown et al., Methods Enzymol., 68: 109–151, 1979, "Chemical Synthesis and Cloning of a Tyrosine TRNA Gene."

Brutlag et al., Comp. App. Biosci., 6: 237–245, 1990, "Improved Sensitivity of Biological Sequence Database Searches."

Chee et al., Science, 274: 610–614, 1996, "Accessing Genetic Information with High–Density DNA Arrays."

Chen and Kwok, Nucleic Acids Research, 25(2): 347–353, 1997, "Template–directed dye–laminator Incorporation (TDI) assay: a homogeneous DNA diagnostic method." based on fluorescence resonance energy transfer.

Chen et al., Proc. Natl. Acad. Sci. USA, 94(20): 10756–10761, 1997, "Fluorescence energy transfer detection as a homogenous DNA diagnostic method."

Clark A.G., Mol. Biol. Evol., 7(2): 111–122, 1990, "Inference of Haplotypes from PCR–amplified Samples of Diploid Populations."

Compton J., Nature, 350: 91–92, 1991, "Nucleic acids sequence–based amplification."

Dempster et al., J.R. Stat. Soc., 39B: 1–38, 1977, "Maximum Likelihood from Incomplete Data via the EM Algorithm".

Dixon, R.A.F., et al.,: Nature, vol. 343, Jan. 18, 1990: pp. 282–284 "Requirement of a 5–lipoxygenase–activating protein for leukotriene systhesis."

Excoffier L. and Slatkin M., Mol. Biol. Evol., 12(5): 921–927, 1995, "Maximum Likelihood Estimation of Molecular Haplotype Frequencies in a Diploid Population."

Grompe et al., Proc. Natl. Acad. Sci. USA, 86:5888–5892, 1989, "Scanning detection of mutations in human ornithine transcarbamoylase by chemical mismatch cleavage."

Grompe, M., Nature Genetics, 5:111–117, 1993, "The rapid detection of unknown mutations in nucleic acids."

(List continued on next page.)

*Primary Examiner*—John S. Brusca
(74) *Attorney, Agent, or Firm*—Saliwanchik, Lloyd & Saliwanchik

(57) ABSTRACT

The invention provides polynucleotides including biallelic markers derived from genes involved in arachidonic acid metabolism and from genomic regions flanking those genes. Primers hybridizing to regions flanking these biallelic markers are also provided. This invention also provides polynucleotides and methods suitable for genotyping a nucleic acid containing sample for one or more biallelic markers of the invention. Further, the invention provides methods to detect a statistical correlation between a biallelic marker allele and a phenotype and/or between a biallelic marker haplotype and a phenotype.

13 Claims, 3 Drawing Sheets

OTHER PUBLICATIONS

Guatelli et al., Proc. Natl. Acad. Sci. USA, 87: 1874–1878, 1990, "Isothermal in vitro amplification of nucleic acids by a multienzyme reaction modeled after retroviral replication."

Hacia et al., Nature Genetics, 14(4): 441–447, 1996, "Detection of heterozygous mutations in BRCA1 using high density oligonucleotide arrays and two–color fluorescence analysis."

Haff L.A. and I.P. Smirnov, Genome research, 7: 378–388, 1997, "Single–Nucleotide Polymorphism Identification Assays Using a Thermostable DNA Polymerase and Delayed Extraction MALDI–TOF Mass Spectrometry."

Harju et al., Clinical Chemistry, 39(11): 2282–2287, 1993, "Colorimeric Solid–Phase Mini–sequencing Assay Illustrated by Detection of 1 –Antitrypsin Z Mutation."

In, K.H., et al., J. Clin., Invest., vol. 99, No. 5, 1997, pp. 1130–1137; The American Society for Clinical Invest. "Naturally Occurring Mutation in the Human 5–Lipoxygenase Gene Promoter that Modify Transcription Factor Binding and Reporter Gene Transcription."

Kozal et al., Nature Medicine, 2(7): 753–759, 1998, "Extensive Polymorphism Observed in HIV–1 Clade B Protease Gene Using High Density Oligonucleotide arrays."

Landergren et al., Genome Research, 8: 769–776, 1998. "Reading Bits of Genetic Information: Methods for Single-Nucleotide Polymorphism Analysis."

Lander and Schork, Science, 265: 2037–2048, 1994, "Genetic Dissection of Complex Trails."

Livak and Hainer, Human Mutation, 3: 379–385, 1994 "A Microtiter Plate Assay for Determining Apolipoprotein E Genotype and Discovery of a Rare Allele."

Livak et al., Nature Genetics, 9: 341–342, 1995, "Towards fully automated genome–wide polymorphism screening."

Marshall et al., PCR Methods and Applications, 4:80–84, 1994, "Detection of HCV RNA by the Asymmetric Gap Ligase Chain Reaction."

Morton, N.E. Am. J. Hum. Genet., 7: 277–318, 1955, "Sequential Tests for the Detection of Linkage."

Narang et al., Methods Enzymol., 68: 90–98, 1979, "Improved Phosphotriester Method for the Synthesis of Gene Fragments."

Newton et al., Nucleic Acids Res., 17(7): 2503–2515, 1989, "Analysis of any point mutation in DNA. The amplification refractory mutation system (ARMS)."

Nickerson, D.A. et al., Proc. Natl. Acad. Sci. USA., 87: 8923–8927, 1990 "Automated DNA diagnostics using an Elisa–based oligonucleotide ligation assay."

Nyren et al., Analytical Biochemistry 208: 171–175, 1993, "Solid Phase DNA Mini–Sequencing by an Enzymatic Luminmetric Inorganic Pyrophosphate Detection Assay."

Orita et al., Proc. Natl. Acad. Sci. USA, 86: 2766–2770, 1989, "Detection of Polymorphisms of Human DNA by Gel Electrophoresis as Single–Strand Conformation Polymorphism."

Pastinen et al., Genome Research, 7: 606–614, 1997 "Minisequencing: A specific Tool DNA Analysis and Diagnostics on Oligonucleotide Arrays."

Pearson and Lipman, Proc. Natl. Acad. Sci. USA, 85: 2444–2448, 1988, "Improved Tools for Biological Sequence Comparison."

Perline et al., Am. J. Hum. Genet., 55: 777–787, 1994 "Toward Fully Automated Genotyping: Allele Assignment, Pedigree Construction, Phase Determination, and Recombination detection in Duchenne Muscular Dystrophy."

Risch, N. and Merlkangas, K., Science, 273: 1516–1517, 1996, "The Future of Genetic Studies of Complex Human Diseases."

Ruano et al., Proc. Natl. Acad. Sci. USA, 87: 6296–6300, 1990, "Haplotype of multiple polymorphisms resolved by enzymatic amplification of single DNA molecules."

Sarkar, G. and Sommer, S.S., Bio Techniques, 10(4): 436–440, 1991, "Haplotyping by Double PCR Amplification of Specific Alleles."

Sarkar, G. and Sommer, S.S., Bio Techniques, 10(5): 590–594, 1991, "Parameters Affecting Susceptibility of PCR Contamination to UC Inactivation."

Schaid et al., Genet Epidermoll., 13: 423–450, 1998, "General Score Tests for Associations of Genetic Markers with Disease Using Cases and their Parents."

Sheffield et al., Proc. Natl. Acad. Sci. USA, 49: 699–706, 1991 "Identification of Novel Rhodopsin Mutations Associated with Retinitis Pigmentosa by GC–clamped Denaturing Gradient Gel Electrophoresis."

Shoemaker et al., Nature Genetics, 14(4): 450–456, 1996, "Quantitative phenotypic analysis of yeast deletion mutants using a highly parallel molecular bar–coding strategy."

Smith, Ann., Hum. Genet., 21: 254–276, 1957, "Counting Methods in Genetical Statistics."

Spielman et al., Am. J. Hum. Genet., 62: 506–516, 1993, "Transmission Test for Linkage Disequillibrium: The Insulin Gene Region and Insulin–dependent Diabetes Mellitus (IDDM)."

Spielman R. and Ewans, W.J. Am. J. Hum. Genet., 62: 450–458, 1998, "A Sibship Test for Linkage in the Presence of Association: The Sib Transmission/Disequllibrium Test."

Syvanen, A., et al., American Journal of Human Gentics, vol. 52, No. 1, 1993, pp. 45–69. Identification of Individuals by Analysis of Biallelic DNA MArkers, Using PCR amd Solid–Phase Minisequencing.

Tyagi et al., Nature Biotechnology, 16: 49–53, 1998, "Multicolor Molecule Beacons for Allele Discrimination."

Walker et al., Clinical Chemistry, 42(1): 9–13, 1996, "Strand displacement amplification (SDA) and transient–state fluorescence polarization detection of Mycobacterium Tuberculosis DNA."

White et al., Genomics, 12: 301–306, 1992, "Detecting Single Base Substitutions as Heteroduplex Polymorphism."

Wolcott, M.J., Clinical Microbiology Reviews, 5(4): 370–386, 1992, "Advances in Nucleic Acid–Based Detection Methods."

Wu et al., Proc. Natl. Acad. Sci. USA 86: 2757–2760, 1989, "Allele–specific enzymatic amplication of 62–globin genomic DNA for diagnosis of sickle cell anemia."

Zhao et al., Am. J. Hum. Genet., 63: 225–240, 1998, "Mapping of Complex Traits by Single–Nucleotide Polymorphisms."

Kruglyak, L., Nature Genetics, USA, New York, NY, vol. 17, No. 1, Sep. 1, 1997, pp. 22–24, "The Use of a Genetic Map of Biallelic Markers in Linkage Studies."

Kennedy, B.P. et al., J Bio Chem, vol. 266, No. 13, 1991, pp. 8511–8516, XP00212878, "Gene characterization and promoter analysis of the human 5Lipoxygenase–Activating protein flap."

Wang, D., et al., American Journal of Human Genetics, Us, New York, vol. 59, No. 4, p. A03 XP002050641, "Toward a Third Generation Genetic Map of the Human Genome Based on Bi–Allelic Polymorphisms,"

Collins, et al., "Variation on a Theme: Cataloging Human DNA Sequence Variation", *Science* (1997), 278(5343):1580.

Yoshimoto, et al., Structure and Chromosomal Localization of Human Arachidonata 12–Lipoxygenase Gene, *J. Biol. Chem.* (1992), pp.24805–24809; American Society for Biochemistry and Molecular Biology, Inc.

Funk, et al., "Characterization of human 12–lipoxygenase genes", *Proc. Natl. Acad. Sol. USA* (1992), 89:3962–3966; Biochemistry.

* cited by examiner

BIALLELIC MARKERS DERIVED FROM GENOMIC REGIONS CARRYING GENES INVOLVED IN ARACHIDONIC ACID METABOLISM

RELATED APPLICATIONS

This application is a continuation of U.S. patent application Ser. No. 09/641,638, filed Aug. 16, 2000, (now U.S. Pat. No. 6,432,648); which is a continuation-in-part of both U.S. patent application Ser. No. 09/502,330 (abandoned), filed Feb. 11, 2000, and International Patent Application No. PCT/IB00/00184, filed Feb. 11, 2000, which are continuations-in-part of U.S. patent application Ser. No. 09/275,267, filed Mar. 23, 1999 (abandoned). U.S. patent application Ser. No. 09/502,330 (abandoned) and International Patent Application No. PCT/IB00/00184 are continuations-in-part of U.S. patent application Ser. No. 09/275,267, filed Mar. 23, 1999 (abandoned), and International Patent Application No. PCT/IB00/00184 claims benefit of United States Provisional Patent Application Serial No. 60/133,200, filed May 7, 1999, and United States Provisional Patent Application Serial No. 60/119,917, filed Feb. 12, 1999. Each of the above applications are hereby incorporated herein in their entirety including any sequence lists, figures, tables, or drawings.

FIELD OF THE INVENTION

The present invention is in the field of pharmacogenomics, and is primarily directed to biallelic markers that are located in or in the vicinity of genes, which have an impact on arachidonic acid metabolism and the uses of these markers. The present invention encompasses methods of establishing associations between these markers and diseases involving arachidonic acid metabolism such as inflammatory diseases as well as associations between these markers and treatment response to drugs acting on arachidonic acid metabolism. The present invention also provides means to determine the genetic predisposition of individuals to such diseases and means to predict responses to such drugs.

BACKGROUND OF THE INVENTION

The metabolites of arachidonic acid and related fatty acids, collectively termed eicosanoids, exhibit a wide range of biological activities affecting virtually every organ system in mammals. Eicosanoids are among the most important chemical mediators and modulators of the inflammatory reaction and contribute to a number of physiological and pathological processes (See Hardman J. G., Goodman, Gilman A., Limbird L. E.; *Goodman & Gilman's The Pharmacological Basis of Therapeutics*, 9$^{th}$ edition, McGraw-Hill, N.Y., 1996).

Physiology, Pathophysiology and Pharmacological Importance of the Eicosanoids

The eicosanoids are extremely prevalent and have been detected in almost every tissue and body fluid. These lipids contribute to a number of physiological and pathological processes including inflammation, smooth muscle tone, hemostasis, thrombosis, parturition and gastrointestinal secretion. Once synthesized in response to a stimulus, the eicosanoids are not stored to any significant extent but are released immediately and act locally. After they act, they are quickly metabolized by local enzymes to inactive forms. Accordingly, the eicosanoids are categorized as autocrine agents or local hormones. They alter the activities of the cells in which they are synthesized and of adjoining cells. The nature of these effects may vary from one type of cell to another, in contrast with the more uniform actions of global hormones such as insulin, for example. Therefore, the eicosanoids, as local chemical messengers, exert a wide variety of effects in virtually every tissue and organ system.

The principal eicosanoids are the prostaglandins (PG), the thromboxanes (TX) and the leukotrienes (LT), though other derivatives of arachidonate, for example lipoxins, are also produced. They fall into different classes designated by letters and the main classes are further subdivided and designated by numbers.

Inflammatory and Immune Responses

Eicosanoids are lipid mediators of inflammation and play a central, often synergistic, role in numerous aspects of inflammatory responses and host defense. Prostaglandins and leukotrienes are released by a host of mechanical, thermal, chemical, bacterial, and other insults, and they contribute importantly to the genesis of the signs and symptoms of inflammation. The ability to mount an inflammatory response is essential for survival in the face of environmental pathogens and injury, although in some situations and diseases the inflammatory response may be exaggerated and sustained for no apparent beneficial reason. This is the case in numerous chronic inflammatory diseases and allergic inflammation. Acute allergic inflammation is characterized by increased blood flow, extravasation of plasma and recruitment of leukocytes. These events are triggered by locally released inflammatory mediators including eicosanoids and more particularly leukotrienes. The leukotrienes generally have powerful effects on vascular permeability and the leukotriene $LTB_4$ is a potent chemoattractant for leukocytes and promotes exudation of plasma. The prostaglandins $PGE_2$ and $PGI_2$ markedly enhance edema formation and leukocyte infiltration in the inflamed region. Moreover, they potentiate the pain-producing activity of bradykinin.

The participation of arachidonic acid (AA) metabolism in inflammatory diseases such as rheumatoid arthritis, asthma and acute allergy is well established. Prostaglandins have been involved in inflammation, pain and fever. Pathological actions of leukotrienes are best understood in terms of their roles in immediate hypersensitivity and asthma. Lipoxygenases, e.g., 5-lipoxygenase (5-LO), 12-lipoxygenase (12-LO), 15-lipoxygenase A (15-LOA), and 15-lipoxygenase B (15-LOB), have been implicated in the pathogenesis of a variety of inflammatory conditions such as psoriasis and arthritis.

Cardiovascular System

The prostaglandins PGEs, $PGF_2$ and $PGD_2$ cause both vasodilation and vasoconstriction. Responses vary with concentration and vascular bed. Systemic blood pressure generally falls in response PGEs, and blood flow to most organs, including the heart, is increased. These effects are particularly striking in some hypertensive patients. Cardiac output is generally increased by prostaglandins of the E and F series. The importance of these vascular actions is emphasized by the participation of $PGI_2$ and $PGE_2$ in the hypotension associated with septic shock. The prostaglandins also have been implicated in the maintenance of patency of the ductus arteriosus. Thromboxane synthase (TXA2), also known as CYP5, is a potent vasoconstrictor. Leukotriene $C_4$ synthase ($LTC_4$) and the leokotriene $LTD_4$ cause hypotension. The leukotrienes have prominent effects on the microvasculature. $LTC_4$ and LTD4 appear to act on the endothelial lining of postcapillary venules to cause exudation of plasma; they are more potent than histamine in this regard. In higher concentrations, LTC4 and LTD4 constrict arterioles and reduce exudation of plasma.

Blood/Platelets

Prostanoids including prostaglandins and thromboxanes exhibit a wide variety of actions in various cells and tissues to maintain local homeostasis in the body. Eicosanoids modify the function of the formed elements of the blood. PGI2 controls the aggregation of platelets in vivo and contributes to the antithrombogenic properties of the intact vascular wall.

TXA2 is a major product of arachidonate metabolism in platelets and, as a powerful inducer of platelet aggregation and the platelet release reaction, is a physiological mediator of platelet aggregation. Pathways of platelet aggregation that are dependent on the generation of TXA2 are sensitive to the inhibitory action of aspirin, which inhibits the cyclooxygenase (COX) pathway. There has been considerable interest in the elucidation of the role played by prostaglandins and TXA2 in platelet aggregation and thrombosis and by $PGI_2$ in the prevention of these events. The platelet thromboxane pathway is activated markedly in acute coronary artery syndromes and aspirin is beneficial in the secondary prevention of coronary and cerebrovascular diseases. PGI that is generated in the vessel wall may be the physiological antagonist of this system; it inhibits platelet aggregation and contributes to the nonthrombogenic properties of the endothelium. According to this concept, $PGI_2$ and TXA2 represent biologically opposite poles of a mechanism for regulating platelet-vessel wall interaction and the formation of hemostatic plugs and intraarterial thrombi. There is interest in drugs which inhibit thromboxane synthase and modulate PGI2 production.

Smooth Muscle

Prostaglandins contract or relax many smooth muscles beside those of the vasculature. The leukotrienes contract most smooth muscles. In general, PGFs and PGD2 contract and PGEs relax bronchial and tracheal muscle. LTC4 and LTD4 are bronchoconstrictors. They act principally on smooth muscle in peripheral airways and are 1000 times more potent than histamine both in vitro and in vivo. They also stimulate bronchial mucus secretion and cause mucosal edema. A complex mixture of chemical messengers is released when sensitized lung tissue is challenged by the appropriate antigen. Various prostaglandins and leukotrienes are prominent components of this mixture. Response to the leukotrienes probably dominates during allergic constriction of the airway. Evidence for this conclusion is the ineffectiveness of inhibitors of cycloxygenase and of histaminergic antagonists in the treatment of human asthma and the protection afforded by leukotriene antagonists in antigen induced bronchoconstriction. A particularly important role for the cysteinyl-leukotrienes (LTC4, LTD4, and LTE4) has been suggested in pathogenesis of asthma, which is now recognized as a chronic inflammatory condition. They are potent spasmogens causing a contraction of bronchiolar muscle and an increase in mucus secretion.

Gastric and Intestinal Secretions

PGEs and PGI2 inhibit gastric acid secretion stimulated by feeding, histamine or gastrin. Mucus secretion in the stomach and small intestine is increased by PGEs. These effects help to maintain the integrity of the gastric mucosa and are referred to as the cytoprotectant properties of PGEs. Furthermore, PGEs and their analogs inhibit gastric damage caused by a variety of ulcerogenic agents and promote healing of duodenal and gastric ulcers. Cytoprotection is of therapeutic importance and $PGE_1$ analogs are used for the prevention of gastric ulcers.

Kidney and Urine Formation

Prostaglandins modulate renal blood flow and may serve to regulate urine formation by both renovascular and tubular effects. Increased biosynthesis of prostaglandins has been associated with Bartter's syndrome, a rare disease, characterized by urinary wasting of $K^+$. Leukotrienes have been involved in the pathophysiology of glomerular immune injury.

Reproduction and Parturition

Much interest is attached to the possible involvement of prostaglandins in reproductive physiology. Lowered concentrations of prostaglandins in semen have been implicated in male infertility. Prostaglandins are also thought to contribute to the symptoms of primary dysmenorrhea. Inhibitors of cyclooxygenase are effective in relieving the symptoms of this condition. Elevated levels of prostaglandins are involved in onset of labor. Inhibitors of cyclooxygenase increase the length of gestation and interrupt premature labor.

Cancer Metastasis

Tumors in animals and certain spontaneous human tumors are accompanied by increased concentrations of local or circulating prostaglandins. Eicosanoids have been shown to be involved in various aspects of neoplasia including cell transformation, tumor promotion, tumor cell growth, and metastasis. Some studies have implicated platelet aggregation and the effects of prostaglandins and hydroxyeicosatetraenoic acid (12-HETE) in the hematogenous metastasis of tumors.

Many of the products of arachidonic acid metabolism are potent mediators of physiological responses and contribute to disorders of development, cellular function, tissue repair, and host defenses in a number of diseases.

Arachidonic Acid Metabolism and Biosynthesis of Eicosanoids

The primary source of eicosanoids in mammalian systems is the metabolic products of arachidonic acid. After stimulation by trauma, infection, or inflammation, translocated phospholipases, especially phospholipase $A_2$, act on membrane phospholipids to liberate arachidonic acid. Once released, arachidonate is metabolized to oxygenated products by several distinct enzyme pathways, including cyclooxygenases, several lipoxygenases, and cytochrome P450s (CYP). The specific enzyme pathway involved determines, which products are formed.

Release of Arachidonic Acid from Cell Membranes and its Regulation

The eicosanoids are a family of substances produced from the polyunsaturated fatty acid arachidonic acid, which is present in plasma-membrane phospholipids. The first rate-limiting step in the biosynthesis of eicosanoids is the release of arachidonic acid from the membrane, a process that is mainly catalyzed by cytosolic phosholipase $A_2$ (cPLA$_2$). The synthesis of eicosanoids begins when a stimulus such as a hormone, a neurotransmitter, a drug or a toxic agent activates cytosolic phospholipase $A_2$. This arachidonic acid specific phospholipase plays a major role in the cell signaling events that initiate the arachidonate cascade. One important trigger of arachidonate release and eicosanoid synthesis involves tissue injury and inflammation.

The activities of many enzymes are regulated by calmodulins (CAL) that serve as calcium sensors in eukaryotic cells. The binding of $Ca^{2+}$ to multiple sites in calmodulin induces a major conformational change that converts it from an inactive to an active form. Activated calmodulin then binds to many enzymes and target proteins in the cell, modifying their activities and thereby regulating various metabolic pathways. Calmodulins are involved in a number of processes regulated by $Ca^{2+}$ including smooth muscle contraction, neurotransmission, apoptosis, cell cycle progression and gene expression. Calmodulins also participate in the regulation of arachidonate release. They directly stimulate cytosolic phospholipase $A_2$, whereas calmodulin antagonists inhibit enzyme activity and the release of arachidonic acid.

Annexins (ANX) are a family of multifunctional calcium and phospholipid-binding proteins, they belong to a family of proteins that interact with phospholipids in a $Ca^{2+}$ dependant manner.

Annexins have been implicated in the pathogenesis of benign and malignant neoplasms of different origins. Moreover, several annexins have also been involved in autoimmune diseases such as systemic lupus erythematosus, rheumatoid arthritis and inflammatory bowel disease. Numerous physiological functions have been attributed to annexins including regulation of membrane traffic during exocytosis and endocytosis, mediation of cytoskeletal-membrane interactions, membrane receptor function, regulation of membrane-dependent enzymes, mitogenic signal transduction, transmembrane ion channel activity, cell-cell adhesion, antiinflammatory properties, inhibition of blood coagulation and inhibition of phospholipase $A_2$. Annexins have been suggested as regulators of prostaglandin metabolism and of the arachidonate cascade as a result of their inhibitory effect on phospholipase $A_2$. It is still a matter of debate as to whether inhibition of phospholipase A2 is the result of calcium-dependent sequestration of phospholipids (substrate depletion mechanism) or a direct effect of the annexins acting via protein-protein interactions. Calpactin I (light chain) is the cellular ligand of annexin II and induces its dimerization. Annexin II and calpactin I (CALPA) constitute a calcium binding complex composed of two light chains (calpactin I) and two heavy chains (annexin II). Calpactin I may function as regulator of annexin II phosphorylation.

The activities of phospholipase $A_2$, annexins and calmodulins are common points of regulation in the formation of all eicosanoids.

Downstream of phospholipase $A_2$, the varying eicosanoid-pathway enzymes found in particular cell types determine which eicosanoids are synthesized in response to particular stimuli.

Cyclooxygenase Pathway

This pathway initiated by cyclooxygenase (COX) leads ultimately to formation of the cyclic endoperoxides, prostaglandins (PG), and thromboxanes (TX). There are two isoforms of the cyclooxygenase, COX-1 and COX-2. The former is constitutively expressed in most cells. In contrast, COX-2 is not normally present but may be induced by certain factors such as cytokines and growth factors. The cyclooxygenases have two distinct activities: an endoperoxidase synthase activity that oxygenates and cyclizes the unesterified precursor fatty acid to form the cyclic endoperoxide PGG and a peroxidase activity that converts PGG to PGH. PGG and PGH are chemically unstable, but they can be transformed enzymatically into a variety of products, including PGI, TXA2, PGE, PGF or PGD. Isomerases lead to the synthesis of $PGE_2$ and $PGD_2$, whereas $PGI_2$ is formed from $PGH_2$ through prostacyclin synthase. TXA2 is formed by thromboxane synthase. Although most tissues are able to synthesize the PGG and PGH intermediates from free arachidonate, the fate of these precursors varies in each tissue and depends on the complement of enzymes that are present and on their relative abundance. For example, lung and spleen are able to synthesize the whole range of products. In contrast, platelets contain thromboxane synthase as the principal enzyme that metabolizes PGH, while endothelial cells contain primarily prostacyclin synthase.

Lipoxygenase Pathways

Lipoxygenases are a family of cytosolic enzymes that catalyze the oxygenation of fatty acids to corresponding lipid hydroperoxides. Arachidonate is metabolized to HPETE (hydroperoxyeicosatetraenoic acid), which is then converted either enzymatically or non-enzymatically to 12-HETE (hydroxyeicosatetraenoic acid). HPETEs may further be converted to hepoxilins and lipoxins. Lipoxygenases differ in their specificity for placing the hydroperoxy group, and tissues differ in the lipoxygenases they contain. These enzymes are referred to as 12-, 15-, 5- and 8-lipoxygenases according to the oxygenation sites in arachidonic acid as substrate.

The lipoxygenases catalyze reactions and generate products of potential relevance to membrane remodeling, cell differentiation and inflammation. Products of the 15-LO pathway could contribute to the pathophysiology of allergic airway inflammation while products of the 12-LO pathway have been implicated in cancer metastasis, psoriasis and inflammation.

Various biological activities have been reported for the 12-lipoxygenase metabolites of arachidonic acid. As other eicosanoids, they are important chemical mediators and modulators of the inflammatory reaction. 12-HETE is the major arachidonic acid metabolite of 12-lipoxygenase and seems to be implicated in a wide-spectrum of biological activities such as stimulation of insulin secretion by pancreatic tissue, suppression of renin production, chemoattraction of leukocytes and initiation of growth-related signaling events, such as activation of oncogenes, protein kinase C, and mitogen-activated protein kinases. 12-lipoxygenase activity and 12-HETE production are also important determining factors in tumor cell metastasis and have been implicated in human prostate cancer and breast cancer (Honn et al., *Cancer Metastasis Rev.*, 13:365–396, 1994, Gao et al., *Adv. Exp. Med. Biol.*, 407:41–53, 1997; Natarajan et al., *J. Clin. Endocr. Metab.*, 82:1790–1789, 1997,). Further, 12-HETE has also been implicated in inflammatory skin diseases such as psoriasis (Hussai et al., *Am. J. Physiol.*, 266:243–253, 1994). As mentioned above, metabolism of arachidonic acid by 12-lipoxygenase further generates lipoxins and hepoxillins. Lipoxins play the role of both immunologic and hemodynamic regulators and a variety of biological activities have been reported for hepoxillins which are related to the release of intracellular calcium and the opening of potassium channels (Yamamoto et al., *Pro. Lipid Res.*, 36:23–41, 1997).

The 5-lipoxygenase (5-LO) is perhaps the most important of these enzymes since it leads to the synthesis of leukotrienes. Activation of the 5-LO enzyme involves its docking to a protein termed 5-lipoxygenase-activating protein (FLAP). This binding activates the enzyme, results in its association with the cell membrane and increased synthesis of 5-HPETE and leukotrienes. Leukotriene A (LTA) synthase is associated with 5-lipoxygenase and promotes the rearrangement of 5-HPETE to an unstable intermediate $LTA_4$; which may be transformed to $LTB_4$ by leukotriene $A_4$ hydrolase (LTA4H); alternatively, it may be conjugated with glutathione by $LTC_4$ synthase to form $LTC_4$. LTA4 hydrolase is a pivotal element in leukotriene biosynthesis. Omega-oxidation is regarded as the major pathway for the catabolism of $LTB_4$. This reaction is catalyzed by $LTB_4$ omega-hydroxylase (LTB4H3) also called CYP4F2. $LTD_4$ is produced by the removal of glutamic acid from $LTC_4$ and $LTE_4$ results from the subsequent cleavage of glycine; the reincorporation of glutamic acid yields $LTF_4$.

Epoxygenase Pathway

Arachidonate is metabolized to a variety of metabolites by enzymes that contain cytochrome P450. The epoxygenase pathway of the arachidonic acid cascade leads to the formation of epoxyeicosatrienoic acids (EETs) and dihydroxyeicosatrienoic acids (DHETs). CYP2J2 is a human cytochrome P450 arachidonic acid epoxygenase expressed in extrahepatic tissues and particularly in the intestine. In addition to the known effects on intestinal vascular tone, CYP2J2 products may be involved in the release of intestinal neuropeptides, control of intestinal motility and modulation of intestinal fluid/electrolyte transport.

Eicosanoid Receptors

The diversity of the effects of eicosanoids is explained by the existence of a number of distinct receptors that mediate their actions. All prostaglandin receptors identified to date are coupled to effector mechanisms through G proteins. Distinct receptors for leukotrienes also have been identified in different tissues, all of these appear to activate phospholipase C.

Therapeutic Agents Interacting with Arachidonic Acid Metabolism

Because of their involvement in so many disease states, there has been a considerable effort to develop effective inhibitors to the formation or action of the eicosanoids. The drugs that influence the eicosanoid pathways are the most commonly used drugs in the world today. Their major uses are to reduce pain, fever and inflammation. Several classes of drugs, most notably the nonsteroidal antiinflammatory drugs (NSAIDs) owe their therapeutic effects to blockade of the formation of eicosanoids. Selective inhibitors of arachidonic acid metabolism also have an important therapeutic value. Inhibition of cyclooxygenase (COX), the enzyme responsible for the biosynthesis of the prostaglandins and certain related autacoids, generally is thought to be a major facet of the mechanism of NSAIDs. Aspirin and newer, widely used drugs belong to the NSAIDs. All NSAIDs are antipyretic, analgesic and antiinflammatory but there are important differences in their activities and in their side effects. The reasons for such differences are not fully understood. Side effects of these drugs include gastrointestinal ulceration, disturbances in platelet function, changes in renal function and hypersensitivity reactions. It is now appreciated that there are two forms of cyclooxygenase (COX), inhibition of COX-2 is thought to mediate the antipyretic, analgesic and antiinflammatory action of NSAIDs, whereas the simultaneous inhibition of COX-1 may result in unwanted side effects. Efforts are under way to identify COX-2 specific agents. But, it is also possible that enhanced generation of lipoxygenase products, due to the diversion of arachidonic acid metabolism from the cyclooxygenase pathway towards the lipoxygenase pathways, contributes to some of the side effects. Effort is being devoted to a search for drugs that will produce more selective interventions by acting farther along the biosynthetic pathways. Several compounds have been described that selectively antagonize responses to TXA2 and to $PGH_2$. Some are receptor antagonists others directly inhibit thromboxane synthase.

Advances in understanding the pathobiology of the inflammatory process has suggested several novel approaches for development of drugs to block this process. These include phospholipase $A_2$ inhibitors. Glucocorticoids are thought to have an effect on arachidonic acid metabolism through the induction of lipocortin that inhibits phospholipase $A_2$.

NSAIDs generally do not inhibit the formation of other eicosanoids such as the lipoxygenase-produced leukotrienes. Substantial evidence indicates that leukotrienes contribute to the inflammatory response through a variety of effects. Leukotrienes have been implicated as mediators of inflammation and immediate hypersensitivity reactions—in particular, human bronchial asthma—and thus considerable effort has been done to develop either inhibitors of the production or blockers of the action of the actions of these mediators. Various therapeutic approaches have been used including 5-lipoxygenase inhibitors, which block leukotriene formation, or cysteinyl leukotriene receptor antagonists, which block receptor function. $LTC_4$ synthase is another key step in biosynthesis of leukotrienes and represents another possible site for therapeutic intervention. Drugs targeting leukotriene biosynthesis are being tested and used for their utility in the treatment of various inflammatory conditions.

Most of these drugs are efficacious in providing relief but all available agents have associated, and sometimes severe, toxicity. Certain individuals display intolerance to aspirin and to other drugs acting on arachidonic acid metabolism; this is manifest by symptoms that range from liver toxicity, gastric and intestinal ulceration, disturbance in platelet function, renal injury, nephritis, vasomotor rhinitis with profuse watery secretions, angioneurotic edema, generalized urticaria, and bronchial asthma to laryngeal edema and bronchoconstriction, hypotension, and shock. The underlying mechanism for these severe side effects is not known. Moreover, while these agents have been highly useful for treatment of acute, self-limited inflammatory conditions; their ability to modify disease progression in chronic inflammatory settings remains an area of controversy. The complexity of the highly regulated pathways and enzymes that lead to the formation of the eicosanoids, has limited the precise identification of the metabolites and enzymes in the arachidonic acid cascade, which play the causal role in pathologies or in side effects to some drugs.

Pharmacogenomics and Arachidonic Acid Metabolism

The vast majority of common diseases, such as cancer, hypertension, diabetes and some inflammatory diseases are polygenic, meaning that they are caused by multiple genes. In addition, these diseases are modulated by environmental factors such as pollutants, chemicals and diet. This is why many diseases are called multifactorial; they result from a synergistic combination of factors, both genetic and environmental. Therapeutic management and drug development could be markedly improved by the identification of specific genetic polymorphisms that determine and predict patient susceptibility to diseases or patient responses to drugs.

To assess the origins of individual variations in disease susceptibility or drug response, pharmacogenomics uses the genomic technologies to identify polymorphisms within genes which are part of biological pathways involved in disease susceptibility, etiology, and development, or more specifically in drug response pathways responsible for a drug's efficacy, tolerance or toxicity. It can provide tools to refine the design of drug development by decreasing the incidence of adverse events in drug tolerance studies, by better defining patient subpopulations of responders and non-responders in efficacy studies and, by combining the results obtained therefrom, to further allow better enlightened individualized drug usage based on efficacy/tolerance prognosis. Pharmacogenomics can also provide tools to identify new targets for designing drugs and to optimize the use of already existing drugs, in order to either increase their response rate and/or exclude non-responders from corresponding treatment, or decrease their undesirable side effects and/or exclude from corresponding treatment patients with marked susceptibility to undesirable side effects. However, for pharmacogenomics to become clinically useful on a large scale, molecular tools and diagnostics tests must become available.

Inflammatory reactions, which are involved in numerous diseases, are highly relevant to pharmacogenomics both because they are at the core of many widespread serious diseases, and because targeting inflammation pathways to design new efficient drugs includes numerous risks of potentiating serious side effects. Arachidonic acid metabolism is particularly relevant since its products, the eicosanoids, are powerful inflammatory molecules and play a role in a number of physiological functions.

Genetic Analysis of Complex Traits

Until recently, the identification of genes linked with detectable traits has relied mainly on a statistical approach called linkage analysis. Linkage analysis is based upon establishing a correlation between the transmission of genetic markers and that of a specific trait throughout generations within a family. Linkage analysis involves the study of families with multiple affected individuals and is useful in the detection of inherited-traits, which are caused by a single gene, or possibly a very small number of genes. Linkage analysis has been successfully applied to map simple genetic traits that show clear Mendelian inheritance patterns and which have a high penetrance (the probability that a person with a given genotype will exhibit a trait). About 100 pathological trait-causing genes have been discovered using linkage analysis over the last 10 years.

But, linkage studies have proven difficult when applied to complex genetic traits. Most traits of medical relevance do not follow simple Mendelian monogenic inheritance. However, complex diseases often aggregate in families, which suggests that there is a genetic component to be found. Such complex traits are often due to the combined action of multiple genes as well as environmental factors. Such complex trait, include susceptibilities to heart disease, hypertension, diabetes, cancer and inflammatory diseases. Drug efficacy, response and tolerance/toxicity can also be considered as multifactoral traits involving a genetic component in the same way as complex diseases. Linkage analysis cannot be applied to the study of such traits for which no large informative families are available. Moreover, because of their low penetrance, such complex traits do not segregate in a clear-cut Mendelian manner as they are passed from one generation to the next. Attempts to map such diseases have been plagued by inconclusive results, demonstrating the need for more sophisticated genetic tools.

Knowledge of genetic variation in the arachidonic acid cascade is important for understanding why some people are more susceptible to disease involving arachidonic acid metabolites or respond differently to treatments targeting arachidonic acid metabolism. Ways to identify genetic polymorphism and to analyze how they impact and predict disease susceptibility and response to treatment are needed.

Although the genes involved in arachidonic acid metabolism represent major drug targets and are of high relevance to pharmaceutical research, we still have scant knowledge concerning the extent and nature of sequence variation in these genes and their regulatory elements. For example, the cDNA and part of the genomic sequence for human 12-lipoxygenase have been cloned and sequenced (Izumi et al., *Proc. Natl. Acad. Sci. USA*, 87:7477–7481, 1990; Funk et al., *Proc. Natl. Acad. Sci. USA*, 87:5638–5642, 1990; Yoshimoto et al., *Biochem. Biophys. Res. Commun.*, 172:1230–1235, 1990, Yoshimoto, et al., *J. Biol. Chem.*, 267:24805–24809, 1992). However, the complete genomic sequence of the 12-lipoxygenase, including its regulatory elements, have not been described.

In the cases where polymorphisms have been identified, the relevance of the variation is rarely understood. While polymorphisms hold promise for use as genetic markers in determining which genes contribute to multigenic or quantitative traits, suitable markers and suitable methods for exploiting those markers have not been found and brought to bare on the genes related to arachidonic acid metabolism.

SUMMARY OF THE INVENTION

The present invention is based on the discovery of a set of novel eicosanoid-related biallelic markers. See Table 7(A–B). These markers are located in the coding regions as well as non-coding regions adjacent to genes which express proteins associated with arachidonic acid metabolism. The position of these markers and knowledge of the surrounding sequence has been used to design polynucleotide compositions which are useful in determining the identity of nucleotides at the marker position, as well as more complex association and haplotyping studies which are useful in determining the genetic basis for disease states involving arachidonic acid metabolism. In addition, the compositions and methods of the invention find use in the identification of the targets for the development of pharmaceutical agents and diagnostic methods, as well as the characterization of the differential efficacious responses to and side effects from pharmaceutical agents acting on arachidonic acid metabolism.

The present invention further stems from the isolation and characterization of the genomic sequence of the 12-lipoxygenase gene including its regulatory regions and of the complete cDNA sequence encoding the 12-lipoxygenase enzyme. Oligonucleotide probes and primers hybridizing specifically with a genomic sequence of 12-lipoxygenase are also part of the invention. Furthermore, an object of the invention consists of recombinant vectors comprising any of the nucleic acid sequences described in the present invention, and in particular of recombinant vectors comprising the promoter region of 12-lipoxygenase or a sequence encoding the 12-lipoxygenase enzyme, as well as cell hosts comprising said nucleic acid sequences or recombinant vectors. The invention also encompasses methods of screening of molecules which, modulate or inhibit the expression of the 12-lipoxygenase gene. The invention is also directed to biallelic markers that are located within the 12-lipoxygenase genomic sequence, these biallelic markers representing useful tools in order to identify a statistically significant association between specific alleles of 12-lipoxygenase gene and one or several disorders related to asthma and/or hepatotoxicity.

A first embodiment of the invention encompasses polynucleotides consisting of, consisting essentially of, or comprising a contiguous span of nucleotides of a sequence selected as an individual or in any combination from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof, or more preferably from SEQ ID Nos. 651–652, 680–724, 726–1072, 1079–1143, 1145–1184, 1186–1193, and 1195–1300, and the complements thereof, wherein said contiguous span is at least 6, 8, 10, 12, 15, 20, 25, 30, 35, 40, 50, 75, 100, 200, 500, or 1000 nucleotides in length, to the extent that such a length is consistent with the lengths of the particular Sequence ID. The present invention also relates to polynucleotides hybridizing under stringent or intermediate conditions to a sequence selected as an individual or in any combination from the group consisting of SEQ ID Nos. 1–70, 72–418, 425–489, 491–530, 532–539, and 541–652, and the complements thereof, preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof. In addition, the polynucleotides of the invention encompass polynucleotides with any further limitation described in this disclosure, or those following, specified alone or in any combination: Said contiguous span may optionally include the eicosanoid-related biallelic marker in said sequence; Optionally either the original or the alternative allele of Table 9 may be specified as being present at said eicosanoid-related biallelic marker; Optionally either the first or the second allele of Tables 8 or 10 may be specified as being present at said eicosanoid-related biallelic marker; Optionally, said polynucleotide may consists of, or consist essentially of a contiguous span which ranges in length from 8, 10, 12, 15, 18 or 20 to 25, 35, 40, 50, 60, 70, or 80 nucleotides, or be specified as being 12, 15, 18, 20, 25, 35, 40, or 50 nucleotides in length and including an eicosanoid-related biallelic marker of said sequence, and optionally the original allele of Table 9 is present at said biallelic marker; Optionally, said biallelic marker may be within 6, 5, 4, 3, 2, or 1 nucleotides of the center of said polynucleotide or at the center of said polynucleotide; Optionally, the 3' end of said contiguous span may be present at the 3' end of said polynucleotide; Optionally, biallelic marker may be present at the 3' end of said polynucleotide; Optionally, the 3' end of said polynucleotide may be located within or at least 2, 4, 6, 8, 10, 12, 15, 18, 20, 25, 50, 100, 250, 500, or 1000 nucleotides upstream of an eicosanoid-related biallelic marker in said sequence, to the extent that such a distance is consistent with the lengths of the particular Sequence ID; Optionally, the 3' end of said polynucleotide may be located 1 nucleotide upstream of an eicosanoid-related biallelic marker in said sequence; and Optionally, said polynucleotide may further comprise a label.

A second embodiment of the invention encompasses any polynucleotide of the invention attached to a solid support. In addition, the polynucleotides of the invention which are attached to a solid support encompass polynucleotides with any further limitation described in this disclosure, or those following, specified alone or in any combination: Optionally, said polynucleotides may be specified as attached individually or in groups of at least 2, 5, 8, 10, 12, 15, 20, or 25 distinct polynucleotides of the inventions to a single solid support; Optionally, polynucleotides other than those of the invention may attached to the same solid support as polynucleotides of the invention; Optionally, when multiple polynucleotides are attached to a solid support they may be attached at random locations, or in an ordered array; Optionally, said ordered array may be addressable.

A third embodiment of the invention encompasses the use of any polynucleotide for, or any polynucleotide for use in, determining the identity of one or more nucleotides at an eicosanoid-related biallelic marker. In addition, the polynucleotides of the invention for use in determining the identity of one or more nucleotides at an eicosanoid-related biallelic marker encompass polynucleotides with any further limitation described in this disclosure, or those following, specified alone or in any combination. Optionally, said eicosanoid-related biallelic marker may be in a sequence selected individually or in any combination from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof; Optionally, said polynucleotide may comprise a sequence disclosed in the present specification; Optionally, said polynucleotide may consist of, or consist essentially of any polynucleotide described in the present specification; Optionally, said determining may be performed in a hybridization assay, sequencing assay, microsequencing assay, or an enzyme-based mismatch detection assay; Optionally, said polynucleotide may be attached to a solid support, array, or addressable array; Optionally, said polynucleotide may be labeled.

A fourth embodiment of the invention encompasses the use of any polynucleotide for, or any polynucleotide for use in, amplifying a segment of nucleotides comprising an eicosanoid-related biallelic marker. In addition, the polynucleotides of the invention for use in amplifying a segment of nucleotides comprising an eicosanoid-related biallelic marker encompass polynucleotides with any further limitation described in this disclosure, or those following, specified alone or in any combination: Optionally, said eicosanoid-related biallelic marker may be in a sequence selected individually or in any combination from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof; Optionally, said polynucleotide may comprise a sequence disclosed in the present specification; Optionally, said polynucleotide may consist of, or consist essentially of any polynucleotide described in the present specification; Optionally, said amplifying may be performed by a PCR or LCR. Optionally, said polynucleotide may be attached to a solid support, array, or addressable array. Optionally, said polynucleotide may be labeled.

A fifth embodiment of the invention encompasses methods of genotyping a biological sample comprising determining the identity of a nucleotide at an eicosanoid-related biallelic marker. In addition, the genotyping methods of the invention encompass methods with any further limitation described in this disclosure, or those following, specified alone or in any combination: Optionally, said eicosanoid-related biallelic marker may be in a sequence selected individually or in any combination from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof, Optionally, said method further comprises determining the identity of a second nucleotide at said biallelic marker, wherein said first nucleotide and second nucleotide are not base paired (by Watson & Crick base pairing) to one another; Optionally, said biological sample is derived from a single individual or subject; Optionally, said method is performed in vitro; Optionally, said biallelic marker is determined for both copies of said biallelic marker present in said individual's genome; Optionally, said biological sample is derived from multiple subjects or individuals; Optionally, said method further comprises amplifying a portion of said sequence comprising the biallelic marker prior to said determining step; Optionally, wherein said amplifying is performed by PCR, LCR, or replication of a recombinant vector comprising an origin of replication and said portion in a host cell; Optionally, wherein said determining is performed by a hybridization assay, sequencing assay, microsequencing assay, or an enzyme-based mismatch detection assay.

A sixth embodiment of the invention comprises methods of estimating the frequency of an allele in a population comprising genotyping individuals from said population for an eicosanoid-related biallelic marker and determining the proportional representation of said biallelic marker in said population. In addition, the methods of estimating the frequency of an allele in a population of the invention encompass methods with any further limitation described in this disclosure, or those following, specified alone or in any combination: Optionally, said eicosanoid-related biallelic marker may be in a sequence selected individually or in any combination from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof; Optionally, determining the frequency of a biallelic marker allele in a population may be accomplished by determining the identity of the nucleotides for both copies of said biallelic marker present in the genome of each individual in said population and calculating the proportional representation of said nucleotide at said eicosanoid-related biallelic marker for the population; Optionally, determining the frequency of a biallelic marker allele in a population may be accomplished by performing a genotyping method on a pooled biological sample derived from a representative number of individuals, or each individual, in said population, and calculating the proportional amount of said nucleotide compared with the total.

A seventh embodiment of the invention comprises methods of detecting an association between an allele and a phenotype, comprising the steps of a) determining the frequency of at least one eicosanoid-related biallelic marker allele in a case population, b) determining the frequency of said eicosanoid-related biallelic marker allele in a control population and; c) determining whether a statistically significant association exists between said genotype and said phenotype. In addition, the methods of detecting an association between an allele and a phenotype of the invention encompass methods with any further limitation described in this disclosure, or those following, specified alone or in any combination: Optionally, said eicosanoid-related biallelic marker may be in a sequence selected individually or in any combination from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof; Optionally, said control population may be a trait negative population, or a random population; Optionally, each of steps a) and b) is performed on a single pooled biological sample derived from each of said populations; Optionally, each of said steps a) and b) is performed on a single pooled biological sample derived from each of said populations; Optionally, each of said steps a) and b) is performed separately on biological samples derived from each individual in said populations; Optionally, said phenotype is a disease involving arachidonic acid metabolism, a response to an agent acting on arachidonic acid metabolism, or a side effects to an agent acting on arachidonic acid metabolism; Optionally, the identity of the nucleotides at the biallelic markers in everyone of the following sequences: SEQ ID Nos. 1–70, 72–418, 425–489, 491–530, 532–539, and 541–652; preferably SEQ ID Nos. 651–652, 655–724, 726–1072, 1079–1143, 1145–1184, 1186–1193, and 1195–1304; or more preferably from SEQ ID Nos. 651–652, 680–724, 726–1072, 1079–1143, 1145–1184, 1186–1193, and 1195–1300 is determined in steps a) and b).

An eighth embodiment of the present invention encompasses methods of estimating the frequency of a haplotype for a set of biallelic markers in a population, comprising the steps of: a) genotyping each individual in said population for at least one eicosanoid-related biallelic marker, b) genotyping each individual in said population for a second biallelic marker by determining the identity of the nucleotides at said second biallelic marker for both copies of said second biallelic marker present in the genome; and c) applying a haplotype determination method to the identities of the nucleotides determined in steps a) and b) to obtain an estimate of said frequency. In addition, the methods of estimating the frequency of a haplotype of the invention encompass methods with any further limitation described in this disclosure, or those following, specified alone or in any combination: Optionally said haplotype determination method is selected from the group consisting of asymmetric PCR amplification, double PCR amplification of specific alleles, the Clark method, or an expectation maximization algorithm; Optionally, said second biallelic marker is an eicosanoid-related biallelic marker in a sequence selected from the group consisting of the biallelic markers of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof; Optionally, the identity of the nucleotides at the biallelic markers in everyone of the sequences: SEQ ID Nos. 1–70, 72–418, 425–489, 491–530, 532–539, and 541–652; preferably SEQ ID Nos. 651–652, 655–724, 726–1072, 1079–1143, 1145–1184, 1186–1193, and 1195–1304; or more preferably from SEQ ID Nos. 651–652, 680–724, 726–1072, 1079–1143, 1145–1184, 1186–1193, and 1195–1300 is determined in steps a) and b).

A ninth embodiment of the present invention encompasses methods of detecting an association between a haplotype and a phenotype, comprising the steps of: a) estimating the frequency of at least one haplotype in a case population according to a method of estimating the frequency of a haplotype of the invention; b) estimating the frequency of said haplotype in a control population according to the method of estimating the frequency of a haplotype of the invention; and c) determining whether a statistically significant association exists between said haplotype and said phenotype. In addition, the methods of detecting an association between a haplotype and a phenotype of the invention encompass methods with any further limitation described in this disclosure, or those following, specified alone or in any combination: Optionally, said eicosanoid-related biallelic marker may be in a sequence selected individually or in any combination from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof; Optionally, said control population may be a trait negative population, or a random population; Optionally, said phenotype is a disease involving arachidonic acid metabolism, a response to an agent acting on arachidonic acid metabolism, or a side effects to an agent acting on arachidonic acid metabolism; Optionally, the identity of the nucleotides at the biallelic markers in everyone of the following sequences: SEQ ID Nos. 1–70, 72–418, 425–489, 491–530, 532–539, and 541–652; preferably SEQ ID Nos. 651–652, 655–724, 726–1072, 1079–1143, 1145–1184, 1186–1193, and 1195–1304; or more preferably from SEQ ID Nos. 651–652, 680–724, 726–1072, 1079–1143, 1145–1184, 1186–1193, and 1195–1300 is included in the estimating steps a) and b).

A tenth embodiment of the present invention is a method of administering a drug or a treatment comprising the steps of: a) obtaining a nucleic acid sample from an individual; b) determining the identity of the polymorphic base of at least one eicosanoid-related biallelic marker or 12-LO-related biallelic marker according to the methods taught herein which is associated with a positive response to said drug or treatment, or at least one eicosanoid-related marker or 12-LO-related biallelic marker or which is associated with a negative response to said drug or treatment; and c) administering said drug or treatment to said individual if said nucleic acid sample contains at least one biallelic marker associated with a positive response to said drug or treatment, or if said nucleic acid sample lacks at least one biallelic marker associated with a negative response to said drug or treatment. In addition, the methods of the present invention for administering a drug or a treatment encompass methods with any further limitation described in this disclosure, or those following, specified alone or in any combination: optionally, said eicosanoid-related biallelic marker or 12-LO-related biallelic marker may be in a sequence selected individually or in any combination from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof; or optionally, the administering step comprises administering the drug or the treatment to the individual if the nucleic acid sample contains said biallelic marker associated with a positive response to the treatment or the drug and the nucleic acid sample lacks said biallelic marker associated with a negative response to the treatment or the drug.

An eleventh embodiment of the present invention is a method of selecting an individual for inclusion in a clinical trial of a treatment or drug comprising the steps of: a) obtaining a nucleic acid sample from an individual; b) determining the identity of the polymorphic base of at least one eicosanoid-related biallelic marker or 12-LO-related biallelic marker which is associated with a positive response to the treatment or the drug, or at least one eicosanoid-related biallelic marker or 12-LO-related biallelic marker which is associated with a negative response to the treatment or the drug in the nucleic acid sample, and c) including the individual in the clinical trial if the nucleic acid sample contains said eicosanoid-related biallelic marker or 12-LO-related biallelic marker associated with a positive response to the treatment or the drug or if the nucleic acid sample lacks said biallelic marker associated with a negative response to the treatment or the drug. In addition, the methods of the present invention for selecting an individual for inclusion in a clinical trial of a treatment or drug encompass methods with any further limitation described in this disclosure, or those following, specified alone or in any combination: Optionally, said eicosanoid-related biallelic marker or 12-LO-related biallelic marker may be in a sequence selected individually or in any combination from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof, or more preferably from SEQ ID Nos. 651–652, 680–724, 726–1072, 1079–1143, 1145–1184, 1186–1193, and 1195–1300, and the complements thereof.

Additional embodiments are set forth in the Detailed Description of the Invention and in the Examples.

BRIEF DESCRIPTION OF THE TABLES

Table 1 contains the first five markers listed in the sequence listing and their corresponding SEQ ID numbers.

Tables 2A–C are a list of 12-LO-related biallelic markers.

Table 3 is a listing of currently available forensic testing systems and their characteristics as compared to the method of the invention.

Table 4 sets forth the number of biallelic markers (VNTRs) needed to obtain, in mean, a ratio of at least $10^6$ or $10^8$.

Table 5 provides an indication of the descriminatory potential of the systems of the invention.

Table 6 is a listing of probabilities for several different types of relationships and likelihood ratios.

Table 7A is a chart containing a list of all of the eicosanoid-related biallelic markers for each gene with an indication of the gene for which the marker is in closest physical proximity, an indication of whether the markers have been validated by microsequencing (with a Y indicating that the markers have been validated by microsequencing and an N indicating that it has not), and an indication of the identity and frequency of the least common allele determined by genotyping (with a blank left to indicate that the frequency has not yet been reported for some markers). The frequencies were determined from DNA samples collected from a random US Caucasian population. When the marker was determined to be homozygous at the particular location for the random US Caucasian population, the homozygous bases were recorded in the "Genotyping Least Common Allele Frequency" column of Table 7A. For example, Seq. ID No. 16 was determined to be homozygous G/G at the biallelic marker position 478 in the US control population, therefore G/G was recorded in the "Genotyping Least Common Allele Frequency" column.

Table 7B contains all of the eicosanoid-related biallelic markers provided in Table 7A; however, they are provided in shorter, easier to search sequences of 47 nucleotides.

Accordingly, Table 7A begins with SEQ ID No. 1 and ends with SEQ ID No. 654, while Table 7B begins with SEQ ID No. 655 and ends with SEQ ID No. 1604 (SEQ ID Nos. 651–654 correspond to the genomic and protein sequences of the invention and are not repeated in Table 7B). Table 1 contains the first five markers listed in the sequence listing and their corresponding SEQ ID numbers in Tables 7A and 7B to illustrate the relationship between Tables 7A and 7B:

TABLE 1

| BIALLELIC MARKER ID | SEQ ID NO. IN TABLE 7A | BIALLELIC MARKER POSITION IN SEQ ID NO. | SEQ ID NO. IN TABLE 7B | BIALLELIC MARKER POSITION IN SEQ ID NO. |
|---|---|---|---|---|
| 10-253-118 | 1 | 478 | 655 | 24 |
| 10-253-298 | 2 | 478 | 656 | 24 |
| 10-253-315 | 3 | 478 | 657 | 24 |
| 10-499-155 | 4 | 478 | 658 | 24 |
| 10-520-256 | 5 | 478 | 659 | 24 |

Table 7B is the same as Table 7A in that it is a list of all of the eicosanoid-related biallelic markers for each gene with an indication of the gene for which the marker is in closest physical proximity, an indication of whether the markers have been validated by microsequencing (with a Y indicating that the markers have been validated by microsequencing and an N indicating that it has not), and an indication of the identity and frequency of the least common allele determined by genotyping (with a blank left to indicate that the frequency has not yet been reported for some markers). However, the "Biallelic Marker Position in SEQ ID No." for all of the eicosanoid-related biallelic markers provided in Table 7B is position 24 (representing the midpoint of the 47 mers that make up Table 7B). The frequencies were determined from DNA samples collected from a random US Caucasian population. When the marker was determined to be homozygous at the particular location for the random US Caucasian population, the homozygous bases were recorded in the "Genotyping Least Common Allele Frequency" column of Table 7B. For example, Seq. ID No. 670 was determined to be homozygous G/G at the biallelic marker position 24 in the US control population, therefore G/G was recorded in the "Genotyping Least Common Allele Frequency" column.

Tables 8, 9, and 10 are charts containing lists of the eicosanoid-related biallelic markers. Each marker is described by indicating its SEQ ID, the biallelic marker ID, and the two most common alleles. Table 8 is a chart containing a list of biallelic markers surrounded by preferred sequences. In the column labeled, "POSITION RANGE OF PREFERRED SEQUENCE" of Table 8 regions of particularly preferred sequences are listed for each SEQ ID, which contain an eicosanoid-related biallelic marker, as well as particularly preferred regions of sequences that do not contain an eicosanoid-related biallelic marker but, which are in sufficiently close proximity to an eicosanoid-related biallelic marker to be useful as amplification or sequencing primers.

Table 11 is a chart listing particular sequences that are useful for designing some of the primers and probes of the invention. Each sequence is described by indicating its Sequence ID and the positions of the first and last nucleotides (position range) of the particular sequence in the Sequence ID.

Table 12 is a chart listing microsequencing primers which have been used to genotype eicosanoid-related biallelic markers (indicated by an *) and other preferred microsequencing primers for use in genotyping eicosanoid-related biallelic markers. Each of the primers which falls within the strand of nucleotides included in the Sequence Listing are described by indicating their Sequence ID number and the positions of the first and last nucleotides (position range) of the primers in the Sequence ID. Since the sequences in the Sequence Listing are single stranded and half the possible microsequencing primers are composed of nucleotide sequences from the complementary strand, the primers that are composed of nucleotides in the complementary strand are described by indicating their SEQ ID numbers and the positions of the first and last nucleotides to which they are complementary (complementary position range) in the Sequence ID.

Table 13 is a chart listing amplification primers which have been used to amplify polynucleotides containing one or more eicosanoid-related biallelic markers. Each of the primers which falls within the strand of nucleotides included in the Sequence Listing are described by indicating their Sequence ID number and the positions of the first and last nucleotides (position range) of the primers in the Sequence ID. Since the sequences in the Sequence Listing are single stranded and half the possible amplification primers are composed of nucleotide sequences from the complementary strand, the primers that are composed of nucleotides in the complementary strand are defined by the SEQ ID numbers and the positions of the first and last nucleotides to which they are complementary (complementary position range) in the Sequence ID.

Table 14 is a chart listing preferred probes useful in genotyping eicosanoid-related biallelic markers by hybridization assays. The probes are 25-mers with an eicosanoid-related biallelic marker in the center position, and described by indicating their Sequence ID number and the positions of the first and last nucleotides (position range) of the probes in the Sequence ID. The probes complementary to the sequences in each position range in each Sequence ID are also understood to be a part of this preferred list even though they are not specified separately.

Table 15 is a table showing the results of the association study between biallelic marker haplotypes from the FLAP gene and asthma.

Table 16 is a table showing the results of the permutation test confirming the statistical significance of the association between asthma and biallelic marker haplotypes from the FLAP gene.

Table 17 is a table showing the results of the association study between 12 biallelic marker haplotypes from the 12-LO gene and asthma.

Table 18A is a table showing the results of allele frequency analysis between seventeen 12-LO biallelic markers and asthma.

Table 18B is a table showing the results of the association study between seventeen 12-LO biallelic marker haplotypes from the 12-LO gene and asthma.

Table 19 is a table showing the results of the association study between 12 biallelic marker haplotypes from the 12-LO gene and hepatotoxicity upon treatment with zileuton.

Table 20A is a table showing the results of the allele frequency analysis between seventeen 12-LO biallelic markers and hepatotoxicity upon treatment with zileuton.

Table 20B is a table showing the results of the association study between seventeen 12-LO biallelic marker haplotypes from the 12-LO gene and hepatotoxicity upon treatment with zileuton.

Table 21 is a table showing a summary of the association study results, permutation tests confirming the statistical significance of the association between asthma and biallelic marker haplotypes from the 12-LO gene, and permutation tests confirming the statistical significance of the association between secondary effects upon treatment with zileuton and biallelic marker haplotypes from the 12-LO gene.

Table 22 is a table showing a summary of the association study results, permutation tests confirming the statistical significance of the association between asthma and additional biallelic marker haplotypes from the 12-LO gene, and permutation tests confirming the statistical significance of the association between secondary effects upon treatment with zileuton and biallelic marker haplotypes from the 12-LO gene.

Table 23 is a chart containing a list of preferred 12-LO-related biallelic markers with an indication of the frequency of the least common allele determined by genotyping. Frequencies were determined in a random US Caucasian population, in an asthmatic population showing no side effects upon treatment with Zyflo™ (ALT−) and in an asthmatic population showing elevated alanine aminotransferase levels upon treatment with Zyflo™ (ALT+).

DETAILED DESCRIPTION OF THE INVENTION

Figure 1:
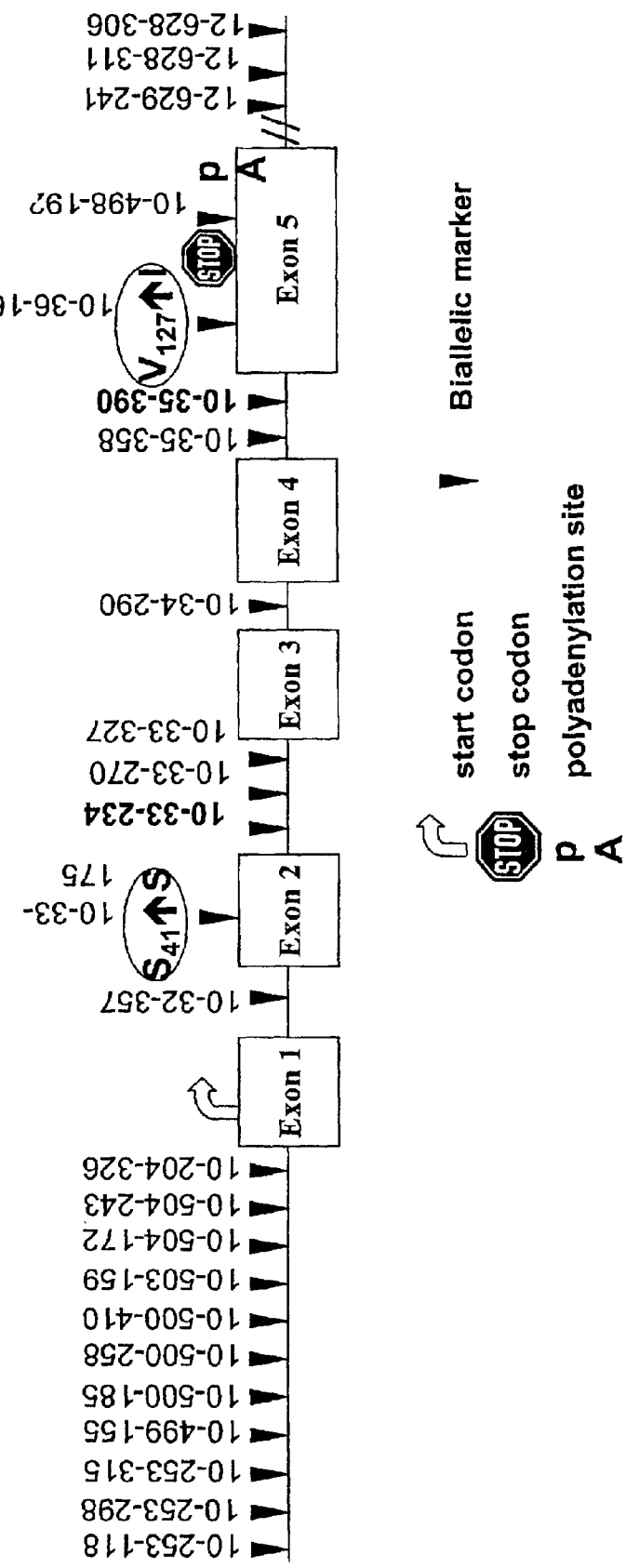
FIG. 1 is a diagram showing the genomic structure of the FLAP gene and the positions of biallelic markers in close proximity of this gene.

Advantages of the Biallelic Markers of the Present Invention

The eicosanoid-related biallelic markers of the present invention offer a number of important advantages over other genetic markers such as RFLP (Restriction fragment length polymorphism) and VNTR (Variable Number of Tandem Repeats) markers.

The first generation of markers, were RFLPs, which are variations that modify the length of a restriction fragment. But methods used to identify and to type RFLPs are relatively wasteful of materials, effort, and time. The second generation of genetic markers were VNTRs, which can be categorized as either minisatellites or microsatellites. Minisatellites are tandemly repeated DNA sequences present in units of 5–50 repeats which are distributed along regions of the human chromosomes ranging from 0.1 to 20 kilobases in length. Since they present many possible alleles, their informative content is very high. Minisatellites are scored by performing Southern blots to identify the number of tandem repeats present in a nucleic acid sample from the individual being tested. However, there are only $10^4$ potential VNTRs that can be typed by Southern blotting. Moreover, both RFLP and VNTR markers are costly and time-consuming to develop and assay in large numbers.

Single nucleotide polymorphism or biallelic markers can be used in the same manner as RFLPs and VNTRs but offer several advantages. Single nucleotide polymorphisms are densely spaced in the human genome and represent the most frequent type of variation. An estimated number of more than $10^7$ sites are scattered along the $3 \times 10^9$ base pairs of the human genome. Therefore, single nucleotide polymorphism occur at a greater frequency and with greater uniformity than RFLP or VNTR markers which means that there is a greater probability that such a marker will be found in close proximity to a genetic locus of interest. Single nucleotide polymorphisms are less variable than VNTR markers but are mutationally more stable.

Also, the different forms of a characterized single nucleotide polymorphism, such as the biallelic markers of the present invention, are often easier to distinguish and can therefore be typed easily on a routine basis. Biallelic markers have single nucleotide based alleles and they have only two common alleles, which allows highly parallel detection and automated scoring. The biallelic markers of the present invention offer the possibility of rapid, high-throughput genotyping of a large number of individuals.

Biallelic markers are densely spaced in the genome, sufficiently informative and can be assayed in large numbers. The combined effects of these advantages make biallelic markers extremely valuable in genetic studies. Biallelic markers can be used in linkage studies in families, in allele sharing methods, in linkage disequilibrium studies in populations, in association studies of case-control populations. An important aspect of the present invention is that biallelic markers allow association studies to be performed to identify genes involved in complex traits. Association studies examine the frequency of marker alleles in unrelated case- and control-populations and are generally employed in the detection of polygenic or sporadic traits. Association studies may be conducted within the general population and are not limited to studies performed on related individuals in affected families (linkage studies). Biallelic markers in different genes can be screened in parallel for direct association with disease or response to a treatment. This multiple gene approach is a powerful tool for a variety of human genetic studies as it provides the necessary statistical power to examine the synergistic effect of multiple genetic factors on a particular phenotype, drug response, sporadic trait, or disease state with a complex genetic etiology.

Candidate Genes of the Present Invention

Different approaches can be employed to perform association studies: genome-wide association studies, candidate region association studies and candidate gene association studies. Genome-wide association studies rely on the screening of genetic markers evenly spaced and covering the entire genome. Candidate region association studies rely on the screening of genetic markers evenly spaced covering a region identified as linked to the trait of interest. The candidate gene approach is based on the study of genetic markers specifically derived from genes potentially involved in a biological pathway related to the trait of interest. In the present invention, genes involved in arachidonic acid metabolism have been chosen as candidate genes. This metabolic pathway leads to the biosynthesis of eicosanoids, which are chemical mediators that play an important role in a number of inflammatory diseases, moreover, these pathways are important drug targets and genetic polymorphisms in these genes are highly relevant in the response to a number of drugs. The candidate gene analysis clearly provides a short-cut approach to the identification of genes and gene polymorphisms related to a particular trait when some information concerning the biology of the trait is available as is the case for arachidonic acid metabolism. However, it should be noted that all of the biallelic markers disclosed in the instant application can be employed as part of genome-wide association studies or as part of candidate region association studies and such uses are specifically contemplated in the present invention and claims. All of the markers are known to be in close proximity to the genes with which they are listed in Table 7. For a portion of the markers, the precise position of the marker with respect to the various coding and non-coding elements of the genes has also been determined.

Definitions

As used interchangeably herein, the terms "oligonucleotides", "nucleic acids" and "polynucleotides" include RNA, DNA, or RNA/DNA hybrid sequences of more than one nucleotide in either single chain or duplex form. The term "nucleotide" as used herein as an adjective to describe molecules comprising RNA, DNA, or RNA/DNA hybrid sequences of any length in single-stranded or duplex form. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar, for examples of analogous linking groups, purine, pyrimidines, and sugars see for example PCT publication No. WO 95/04064. However, the polynucleotides of the invention are preferably comprised of greater than 50% conventional deoxyribose nucleotides, and most preferably greater than 90% conventional deoxyribose nucleotides. The polynucleotide sequences of the invention may be prepared by any known method, including synthetic, recombinant, ex vivo generation, or a combination thereof, as well as utilizing any purification methods known in the art.

Throughout the present specification, the expression "nucleotide sequence" may be employed to designate indifferently a polynucleotide or a nucleic acid. More precisely, the expression "nucleotide sequence" encompasses the nucleic material itself and is thus not restricted to the sequence information (i.e. the succession of letters chosen among the four base letters) that biochemically characterizes a specific DNA or RNA molecule.

The term "polypeptide" refers to a polymer of amino without regard to the length of the polymer; thus, peptides, oligopeptides, and proteins are included within the definition of polypeptide. This term also does not specify or exclude prost-expression modifications of polypeptides, for example, polypeptides which include the covalent attachment of glycosyl groups, acetyl groups, phosphate groups, lipid groups and the like are expressly encompassed by the term polypeptide. Also included within the definition are polypeptides which contain one or more analogs of an amino acid (including, for example, non-naturally occurring amino acids, amino acids which only occur naturally in an unrelated biological system, modified amino acids from mammalian systems etc.), polypeptides with substituted linkages, as well as other modifications known in the art, both naturally occurring and non-naturally occurring.

The term "recombinant polypeptide" is used herein to refer to polypeptides that have been artificially designed and which comprise at least two polypeptide sequences that are not found as contiguous polypeptide sequences in their initial natural environment, or to refer to polypeptides which have been expressed from a recombinant polynucleotide.

As used herein, the term "isolated" requires that the material be removed from its original environment (e.g., the natural environment if it is naturally occurring). For example, a naturally-occurring polynucleotide present in a living animal is not isolated, but the same polynucleotide, separated from some or all of the coexisting materials in the natural system, is isolated. Specifically excluded from the definition of "isolated" are: naturally occurring chromosomes (e.g., chromosome spreads) artificial chromosome libraries, genomic libraries, and cDNA libraries that exist either as an in vitro nucleic acid preparation or as a transfected/transformed host cell preparation, wherein the host cells are either an in vitro heterogeneous preparation or plated as a heterogeneous population of single colonies. Also specifically excluded are the above libraries wherein the 5' EST makes up less than 5% of the number of nucleic acid inserts in the vector molecules. Further specifically excluded are whole cell genomic DNA or whole cell RNA preparations (including said whole cell preparations which are mechanically sheared or enzymaticly digested). Further specifically excluded are the above whole cell preparations as either an in vitro preparation or as a heterogeneous mixture separated by electrophoresis (including blot transfers of the same) wherein the polynucleotide of the invention have not been further separated from the heterologous polynucleotides in the electrophoresis medium (e.g., further separating by excising a single band from a heterogeneous band population in an agarose gel or nylon blot).

As used herein, the term "purified" does not require absolute purity; rather, it is intended as a relative definition. Individual 5' EST clones isolated from a cDNA library have been conventionally purified to electrophoretic homogeneity. The sequences obtained from these clones could not be obtained directly either from the library or from total human DNA. The cDNA clones are not naturally occurring as such, but rather are obtained via manipulation of a partially purified naturally occurring substance (messenger RNA). The conversion of mRNA into a cDNA library involves the creation of a synthetic substance (cDNA) and pure individual cDNA clones can be isolated from the synthetic library by clonal selection. Thus, creating a cDNA library from messenger RNA and subsequently isolating individual clones from that library results in an approximately $10^{4-10^6}$ fold purification of the native message. Purification of starting material or natural material to at least one order of magnitude, preferably two or three orders, and more preferably four or five orders of magnitude is expressly contemplated. Alternatively, purification may be expressed as "at least" a percent purity relative to heterologous polynucleotides (DNA, RNA or both). As a preferred embodiment, the polynucleotides of the present invention are at least; 10%, 20%, 30%, 40%, 50%, 60%, 70%, 80%, 90%, 95%, 96%, 96%, 98%, 99%, or 100% pure relative to heterologous polynucleotides. As a further preferred embodiment the polynucleotides have an "at least" purity ranging from any number, to the thousandth position, between 90% and 100% (e.g., 5' EST at least 99.995% pure) relative to heterologous polynucleotides. Additionally, purity of the polynucleotides may be expressed as a percentage (as described above) relative to all materials and compounds other than the carrier solution. Each number, to the thousandth position, may be claimed as individual species of purity. The term "primer" denotes a specific oligonucleotide sequence which is complementary to a target nucleotide sequence and used to hybridize to the target nucleotide sequence. A primer serves as an initiation point for nucleotide polymerization catalyzed by DNA polymerase, RNA polymerase or reverse transcriptase.

The term "probe" denotes a defined nucleic acid segment (or nucleotide analog segment, e.g., polynucleotide as defined herein) which can be used to identify a specific polynucleotide sequence present in samples, said nucleic acid segment comprising a nucleotide sequence complementary of the specific polynucleotide sequence to be identified.

The term "disease involving arachidonic acid metabolism" refers to a condition linked to disturbances in expression, production or cellular response to eicosanoids such as prostaglandins, thromboxanes, prostacyclins, leukotrienes or hydroperoxyeicosaetrenoic acids. A disease involving arachidonic acid metabolism further refers to a condition involving one or several enzymes of the distinct enzyme systems contributing to arachidonate metabolism including particularly the cyclooxygenase pathway and the lipoxygenase pathway and the arachadonic acid metabolites of such systems including 12-HETE, 12-HPETE, lipoxins and hepoxolins. "Diseases involving arachidonic acid metabolism" also include chronic inflammatory diseases, acute allergic inflammation and inflammatory conditions such as pain, fever, hypersensitivity, asthma, psoriasis and arthritis. "Diseases involving arachidonic acid metabolism" also include disorders in platelet function, blood pressure, thrombosis, renal function, host defense mechanism, hemostasis, smooth muscle tone, male infertility, primary dysmenorrhea, disorders in parturition, and disorders in tissue injury repair, as well as disorders in cellular function and development. "Diseases involving arachidonic acid metabolism" also include diseases such as gastrointestinal ulceration, coronary and cerebrovascular syndromes, glomerular immune injury and cancer.

The term "agent acting on arachidonic acid metabolism" refers to a drug or a compound modulating the activity or concentration of an enzyme or regulatory molecule involved in arachidonic acid metabolism, including but not limited to cyclooxygenase, prostacyclin synthase, thromboxane synthase, lipoxygenases, 5-lipoxygenase and 5-lipoxygenase activating protein. "Agent acting on arachidonic acid metabolism" further refers to non-steroidal anti-inflammatory drugs (NSAIDs), eicosanoid receptor antagonists, eicosanoid analogs, COX-1 inhibitors, COX-2 inhibitors, thromboxane synthase inhibitors, 5-lipoxygenase inhibitors and 5-lipoxygenase activating protein inhibitors. "Agent acting on arachidonic acid metabolism" also refers to compounds modulating the formation and action of eicosanoids such as prostaglandins, prostacyclins, thromboxanes, leukotrienes or hydroperoxyeicosaetrenoic acids.

The terms "response to an agent acting on arachidonic acid metabolism" refer to drug efficacy, including but not limited to ability to metabolize a compound, to the ability to convert a pro-drug to an active drug, and to the pharmacokinetics (absorption, distribution, elimination) and the pharmacodynamics (receptor-related) of a drug in an individual.

The terms "side effects to an agent acting on arachidonic acid metabolism" refer to adverse effects of therapy resulting from extensions of the principal pharmacological action of the drug or to idiosyncratic adverse reactions resulting from an interaction of the drug with unique host factors. "Side effects to an agent acting on arachidonic acid metabolism" include, but are not limited to, adverse reactions such as dermatologic, hematologic or hepatologic toxicities and further includes gastric and intestinal ulceration, disturbance in platelet function, renal injury, nephritis, vasomotor rhinitis with profuse watery secretions, angioneurotic edema, generalized urticaria, and bronchial asthma to laryngeal edema and bronchoconstriction, hypotension, and shock.

The terms "trait" and "phenotype" are used interchangeably herein and refer to any visible, detectable or otherwise measurable property of an organism such as symptoms of, or susceptibility to a disease for example. Typically the terms "trait" or "phenotype" are used herein to refer to symptoms of, or susceptibility to a disease involving arachidonic acid metabolism; or to refer to an individual's response to an agent acting on arachidonic acid metabolism; or to refer to symptoms of, or susceptibility to side effects to an agent acting on arachidonic acid metabolism.

The terms "agent acting on 5-lipoxygenase" refers to a drug or a compound modulating the activity or concentration of the 5-lipoxygenase enzyme such as 5-lipoxygenase inhibitors. "Agent acting on 5-lipoxygenase" also refers to compounds modulating the formation and action of leukotrienes.

The terms "side effects to an agent acting on 5-lipoxygenase" include, but are not limited to, adverse reactions such as dermatologic, hematologic or hepatologic toxicities.

The term "allele" is used herein to refer to variants of a nucleotide sequence. A biallelic polymorphism has two forms. Typically the first identified allele is designated as the original allele whereas other alleles are designated as alternative alleles. Diploid organisms may be homozygous or heterozygous for an allelic form.

The term "heterozygosity rate" is used herein to refer to the incidence of individuals in a population, which are heterozygous at a particular allele. In a biallelic system the heterozygosity rate is on average equal to $2P_a(1-P_a)$, where $P_a$ is the frequency of the least common allele. In order to be useful in genetic studies a genetic marker should have an adequate level of heterozygosity to allow a reasonable probability that a randomly selected person will be heterozygous.

The term "genotype" as used herein refers the identity of the alleles present in an individual or a sample. In the context of the present invention a genotype preferably refers to the description of the biallelic marker alleles present in an individual or a sample. The term "genotyping" a sample or an individual for a biallelic marker consists of determining the specific allele or the specific nucleotide carried by an individual at a biallelic marker.

The term "mutation" as used herein refers to a difference in DNA sequence between or among different genomes or individuals which has a frequency below 1%.

The term "haplotype" refers to a combination of alleles present in an individual or a sample. In the context of the present invention a haplotype preferably refers to a combination of biallelic marker alleles found in a given individual and which may be associated with a phenotype.

The term "polymorphism" as used herein refers to the occurrence of two or more alternative genomic sequences or alleles between or among different genomes or individuals. "Polymorphic" refers to the condition in which two or more variants of a specific genomic sequence can be found in a population. A "polymorphic site" is the locus at which the variation occurs. A single nucleotide polymorphism is a single base pair change. Typically a single nucleotide polymorphism is the replacement of one nucleotide by another nucleotide at the polymorphic site. Deletion of a single nucleotide or insertion of a single nucleotide, also give rise to single nucleotide polymorphisms. In the context of the present invention "single nucleotide polymorphism" preferably refers to a single nucleotide substitution. Typically, between different genomes or between different individuals, the polymorphic site may be occupied by two different nucleotides.

The terms "biallelic polymorphism" and "biallelic marker" are used interchangeably herein to refer to a polymorphism having two alleles at a fairly high frequency in the population, preferably a single nucleotide polymorphism. A "biallelic marker allele" refers to the nucleotide variants present at a biallelic marker site. Typically the frequency of the less common allele of the biallelic markers of the present invention has been validated to be greater than 1%, preferably the frequency is greater than 10%, more preferably the frequency is at least 20% (i.e. heterozygosity rate of at least 0.32), even more preferably the frequency is at least 30% (i.e. heterozygosity rate of at least 0.42). A biallelic marker wherein the frequency of the less common allele is 30% or more is termed a "high quality biallelic marker."

The location of nucleotides in a polynucleotide with respect to the center of the polynucleotide are described herein in the following manner. When a polynucleotide has an odd number of nucleotides, the nucleotide at an equal distance from the 3' and 5' ends of the polynucleotide is considered to be "at the center" of the polynucleotide, and any nucleotide immediately adjacent to the nucleotide at the center, or the nucleotide at the center itself is considered to be "within 1 nucleotide of the center." With an odd number of nucleotides in a polynucleotide any of the five nucleotides positions in the middle of the polynucleotide would be considered to be within 2 nucleotides of the center, and so on. When a polynucleotide has an even number of nucleotides, there would be a bond and not a nucleotide at the center of the polynucleotide. Thus, either of the two central nucleotides would be considered to be "within 1 nucleotide of the center" and any of the four nucleotides in the middle of the polynucleotide would be considered to be "within 2 nucleotides of the center", and so on. For polymorphisms which involve the substitution, insertion or deletion of 1 or more nucleotides, the polymorphism, allele or biallelic marker is "at the center" of a polynucleotide if the difference between the distance from the substituted, inserted, or deleted polynucleotides of the polymorphism and the 3' end of the polynucleotide, and the distance from the substituted, inserted, or deleted polynucleotides of the polymorphism and the 5' end of the polynucleotide is zero or one nucleotide. If this difference is 0 to 3, then the polymorphism is considered to be "within 1 nucleotide of the center." If the difference is 0 to 5, the polymorphism is considered to be "within 2 nucleotides of the center." If the difference is 0 to 7, the polymorphism is considered to be "within 3 nucleotides of the center," and so on. For polymorphisms which involve the substitution, insertion or deletion of 1 or more nucleotides, the polymorphism, allele or biallelic marker is "at the center" of a polynucleotide if the difference between the distance from the substituted, inserted, or deleted polynucleotides of the polymorphism and the 3' end of the polynucleotide, and the distance from the substituted, inserted, or deleted polynucleotides of the polymorphism and the 5' end of the polynucleotide is zero or one nucleotide. If this difference is 0 to 3, then the polymorphism is considered to be "within 1 nucleotide of the center." If the difference is 0 to 5, the polymorphism is considered to be "within 2 nucleotides of the center." If the difference is 0 to 7, the polymorphism is considered to be "within 3 nucleotides of the center," and so on.

A "promoter" refers to a DNA sequence recognized by the synthetic machinery of the cell required to initiate the specific transcription of a gene.

As used herein, the term "operably linked" refers to a linkage of polynucleotide elements in a functional relationship. For instance, a promoter or enhancer is operably linked to a coding sequence if it affects the transcription of the coding sequence. More precisely, two DNA molecules (such as a polynucleotide containing a promoter region and a polynucleotide encoding a desired polypeptide or polynucleotide) are said to be "operably linked" if the nature of the linkage between the two polynucleotides does not (1) result in the introduction of a frame-shift mutation or (2) interfere with the ability of the polynucleotide containing the promoter to direct the transcription of the coding polynucleotide.

The term "upstream" is used herein to refer to a location, which is toward the 5' end of the polynucleotide from a specific reference point.

The terms "base paired" and "Watson & Crick base paired" are used interchangeably herein to refer to nucleotides which can be hydrogen bonded to one another be virtue of their sequence identities in a manner like that found in double-helical DNA with thymine or uracil residues linked to adenine residues by two hydrogen bonds and cytosine and guanine residues linked by three hydrogen bonds (See Stryer, L., *Biochemistry*, 4$^{th}$ edition, 1995).

The terms "complementary" or "complement thereof" are used herein to refer to the sequences of polynucleotides which is capable of forming Watson & Crick base pairing with another specified polynucleotide throughout the entirety of the complementary region. This term is applied to pairs of polynucleotides based solely upon their sequences and not any particular set of conditions under which the two polynucleotides would actually bind.

As used herein, the term "non-human animal" refers to any non-human vertebrate, birds and more usually mammals, preferably primates, farm animals such as swine, goats, sheep, donkeys, and horses, rabbits or rodents, more preferably rats or mice. As used herein, the term "animal" is used to refer to any vertebrate, preferable a mammal. Both the terms "animal" and "mammal" expressly embrace human subjects unless preceded with the term "non-human."

As used herein, the term "antibody" refers to a polypeptide or group of polypeptides which are comprised of at least one binding domain, where an antibody binding domain is formed from the folding of variable domains of an antibody molecule to form three-dimensional binding spaces with an internal surface shape and charge distribution complementary to the features of an antigenic determinant of an antigen., which allows an immunological reaction with the antigen. Antibodies include recombinant proteins comprising the binding domains, as wells as fragments, including Fab, Fab', F(ab)$_2$, and F(ab')$_2$ fragments.

As used herein, an "antigenic determinant" is the portion of an antigen molecule, in this case a 12-LO polypeptide, that determines the specificity of the antigen-antibody reaction. An "epitope" refers to an antigenic determinant of a polypeptide. An epitope can comprise as few as 3 amino acids in a spatial conformation which, is unique to the epitope. Generally an epitope consists of at least 6 such amino acids, and more usually at least 8–10 such amino acids. Methods for determining the amino acids which make up an epitope include x-ray crystallography, 2-dimensional nuclear magnetic resonance, and epitope mapping e.g. the Pepscan method described by H. Mario Geysen et al. 1984. Proc. Natl. Acad. Sci. U.S.A. 81:3998–4002; PCT Publication No. WO 84/03564; and PCT Publication No. WO 84/03506, the disclosures of which are incorporated herein by reference in their entireties.

As used herein the term "eicosanoid-related biallelic marker" relates to a set of biallelic markers in linkage disequilibrium with all of the genes disclosed in Table 7(A–B) with the exception of FLAP. All of these genes express proteins that are related to eicosanoid metabolism.

The term eicosanoid-related biallelic marker encompasses all of the biallelic markers disclosed in Table 7(A–B), preferably the biallelic markers found in SEQ ID Nos. 651–652, 655–724, 726–1072, 1079–1143, 1145–1184, 1186–1193, and 1195–1304; or more preferably from SEQ ID Nos. 651–652, 680–724, 726–1072, 1079–1143, 1145–1184, 1186–1193, and 1195–1300. The preferred eicosanoid-related biallelic marker alleles of the present invention include each one the alleles described in Tables 7, 8, 9, and 10 individually or in groups consisting of all the possible combinations of the alleles included in Tables 7(A–B), 8, 9, and 10, preferably the biallelic markers found in SEQ ID Nos. 1–70, 72–418, 425–489, 491–530, 532–539, and 541–652; preferably SEQ ID Nos. 651–652, 655–724, 726–1072, 1079–1143, 1145–1184, 1186–1193, and 1195–1304; or more preferably from SEQ ID Nos. 651–652, 680–724, 726–1072, 1079–1143, 1145–1184, 1186–1193, and 1195–1300.

As used herein the term "12-LO-related biallelic marker" and "12-lipoxygenase-related biallelic marker" are used interchangeably herein to relate to all biallelic markers in linkage disequilibrium with the biallelic markers of the 12-lipoxygenase gene. The term 12-LO-related biallelic marker includes both the genic and non-genic biallelic markers described in Table 2(a–c).

The term "non-genic" is used herein to describe 12-LO-related biallelic markers, as well as polynucleotides and primers which occur outside the nucleotide positions shown in the human 12-LO genomic sequence of SEQ ID No. 651. The term "genic" is used herein to describe 12-LO-related biallelic markers as well as polynucleotides and primers which do occur in the nucleotide positions shown in the human 12-LO genomic sequence of SEQ ID No 651.

The term "sequence described in Table 7(A–B)" is used herein to refer to the entire collection of nucleotide sequences or any individual sequence defined in Table 7(A–B). The SEQ ID that contains each "sequence described in Table 7(A–B)" is provided in the column labeled, "SEQ ID NO." The column labeled "Gene" indicates the gene for which the marker is in closest physical proximity, an indication of whether the markers have been validated by microsequencing (with a Y indicating that the markers have been validated by microsequencing and an N indicating that it has not), and an indication of the identity and frequency of the least common allele determined by genotyping (with a blank left to indicate that the frequency has not yet been reported for some markers). The frequencies were determined from DNA samples collected from a random US Caucasian population.

The term "sequence described in Table 7B" is used herein to refer to the entire collection of nucleotide sequences or any individual sequence defined in Table 7B. The SEQ ID that contains each "sequence described in Table 7B" is provided in the column labeled, "SEQ ID NO." The column labeled "Gene" indicates the gene for which the marker is in closest physical proximity, an indication of whether the markers have been validated by microsequencing (with a Y indicating that the markers have been validated by microsequencing and an N indicating that it has not), and an indication of the identity and frequency of the least common allele determined by genotyping (with a blank left to indicate that the frequency has not yet been reported for some markers). The frequencies were determined from DNA samples collected from a random US Caucasian population. The "Biallelic Marker location in SEQ ID No." indicates the biallelic marker location within the 47 nucleotide sequence. InTable 7B, this location is 24 for all of the markers.

The term "sequence described in Table 8" is used herein to refer to the entire collection of nucleotide sequences or any individual sequence defined in Table 8. The SEQ ID that contains each "sequence described in Table 8" is provided in the column labeled, "SEQ ID NO." The range of nucleotide positions within the Sequence ID of which each sequence consists is provided in the same row as the Sequence ID in a column labeled, "POSITION RANGE OF PREFERRED SEQUENCE". It should be noted that some of the Sequence ID numbers have multiple sequence ranges listed, because they contain multiple "sequences described in Table 8." Unless otherwise noted the term "sequence described in Table 8" is to be construed as encompassing sequences that contain either of the two alleles listed in the columns labeled, "$1^{ST}$ ALLELE" and "$2^{ND}$ ALLELE" at the position identified in field <222> of the allele feature in the appended Sequence Listing for each Sequence ID number referenced in Table 8. For all inventions which relate to biallelic markers or sequences described in Table 8, a preferred set of markers or sequences excludes Sequence ID Nos. 1–10, 19, 23–25, and 647–650.

The term "sequence described in Table 9" is used herein to refer to the entire collection of nucleotide sequences or any individual sequence defined in Table 9. Unless otherwise noted, the "sequences described in Table 9" consist of the entire sequence of each Sequence ID provided in the column labeled, "SEQ ID NO." Also unless otherwise noted the term "sequence described in Table 9" is to be construed as encompassing sequences that contain either of the two alleles listed in the columns labeled, "ORIGINAL ALLELE" and "ALTERNATIVE ALLELE" at the position identified in field <222> of the allele feature in the appended Sequence Listing for each Sequence ID number referenced in Table 9. For all inventions which relate to biallelic markers or sequences described in Table 9, a preferred set of markers or sequences excludes Sequence ID Nos. 11–18 and 20–21.

The term "sequence described in Table 10" is used herein to refer to the entire collection of nucleotide sequences or any individual sequence defined in Table 10. Unless otherwise noted, the "sequences described in Table 10" consist of the entire sequence of each Sequence ID provided in the column labeled, "SEQ ID NO." Also unless otherwise noted the term "sequence described in Table 10" is to be construed as encompassing sequences that contain either of the two alleles listed in the columns labeled, "$1^{ST}$ ALLELE" and "$2^{ND}$ ALLELE" at the position identified in field <222> of the allele feature in the appended Sequence Listing for each Sequence ID number referenced in Table 10. For all inventions which relate to biallelic markers or sequences described in Table 8, a preferred set of markers or sequences excludes Sequence ID No. 22.

The term "sequence described in Table 11" is used herein to refer to the entire collection of nucleotide sequences or any individual sequence defined in Table 11. The SEQ ID that contains each "sequence described in Table 11" is provided in the column labeled, "SEQ ID NO." The range of nucleotide positions within the Sequence ID of which each sequence consists is provided in the same row as the Sequence ID in a column labeled, "POSITION RANGE OF PREFERRED SEQUENCE". It should be noted that some of the Sequence ID numbers have multiple sequence ranges listed, because they contain multiple "sequences described in Table 11."

The term "sequence described in Table 12" is used herein to refer to the entire collection of nucleotide sequences or any individual sequence defined in Table 12. The SEQ ID that contains each "sequence described in Table 12" is provided in the column labeled "SEQ ID." The range of nucleotide positions within the Sequence ID of which half of the sequences consists is provided in the same row as the Sequence ID in a column labeled, "POSITION RANGE OF MICROSEQUENCING PRIMERS." The remaining half of the sequences described in Table 12 are complementary to the range of nucleotide positions within the Sequence ID provided in the same row as the Sequence ID in a column labeled, "COMPLEMENTARY POSITION RANGE OF MICROSEQUENCING PRIMERS." For all inventions which relate to biallelic markers or sequences described in Table 12, a more preferred set of markers or sequences consists of those markers or sequences found in SEQ ID Nos. 26–70, 72–418, 425–489, 491–530, 532–539, 541–646, and 651–652.

The term "sequence described in Table 13" is used herein to refer to the entire collection of nucleotide sequences or any individual sequence defined in Table 13. The SEQ ID that contains each "sequence described in Table 13" is provided in the column labeled, "SEQ ID." The range of nucleotide positions within the Sequence ID of which half of the sequences consists is provided in the same row as the Sequence ID in a column labeled, "POSITION RANGE OF AMPLIFICATION PRIMERS." The remaining half of the sequences described in Table 13 are complementary to the range of nucleotide positions within the Sequence ID provided in the same row as the Sequence ID in a column labeled, "COMPLEMENTARY POSITION RANGE OF AMPLIFICATION PRIMERS." For all inventions which relate to biallelic markers or sequences described in Table 13, a more preferred set of markers or sequences consists of those markers or sequences found in SEQ ID Nos. 26–70, 72–418, 425–489, 491–530, 532–539, 541–646.

The term "sequence described in Table 13" is used herein to refer to the entire collection of nucleotide sequences or any individual sequence defined in Table 13. The SEQ ID that contains each "sequence described in Table 13" is provided in the column labeled, "SEQ ID". The range of nucleotide positions within the Sequence ID of which each sequence consists is provided in the same row as the Sequence ID in a column labeled, "POSITION RANGE OF PROBES". The sequences which are complementary to the ranges listed in the column labeled, "POSITION RANGE OF PROBES" are also encompassed by the term, "sequence described in Table 13." Unless otherwise noted the term "sequence described in Table 13" is to be construed as encompassing sequences that contain either of the two alleles listed in the allele feature in the appended Sequence Listing for each Sequence ID number referenced in Table 13. For all inventions which relate to biallelic markers or sequences described in Table 13, a more preferred set of markers or sequences consists of those markers or sequences found in SEQ ID Nos. 26–70, 72–418, 425–489, 491–530, 532–539, 541–646, and 651–652.

The terms "biallelic marker described in Table" and "allele described in Table" are used herein to refer to any or all alleles which are listed in the allele feature in the appended Sequence Listing for each Sequence ID number referenced in the particular Table being mentioned.

The following abbreviations are used in this disclosure: the $LTB_4H_2$ gene is abbreviated LTB4H2; leukotriene $B_4$-12-OH dehydrogenase is abbreviated LTB4-12OH; leukotriene $B_4$ receptor is abbreviated LTB4R; PGD-synthase is abbreviated PGDS; and PG-15-OH dehydrogenase is abbreviated PG15OH.

Variants and Fragments

The invention also relates to variants and fragments of the polynucleotides described herein, particularly of a 12-LO gene containing one or more biallelic markers according to the invention.

Variants of polynucleotides, as the term is used herein, are polynucleotides that differ from a reference polynucleotide. A variant of a polynucleotide may be a naturally occurring variant such as a naturally occurring allelic variant, or it may be a variant that is not known to occur naturally. Such non-naturally occurring variants of the polynucleotide may be made by mutagenesis techniques, including those applied to polynucleotides, cells or organisms. Generally, differences are limited so that the nucleotide sequences of the reference and the variant are closely similar overall and, in many regions, identical. Variants of polynucleotides according to the invention include, without being limited to, nucleotide sequences which are at least 95% identical, preferably at least 99% identical, more particularly at least 99.5% identical, and most preferably at least 99.8% identical to a polynucleotide selected from the group consisting of the polynucleotides of a sequence from any sequence in the Sequence Listing as well as sequences which are complementary thereto or to any polynucleotide fragment of at least 8 consecutive nucleotides of a sequence from any sequence in the Sequence Listing. Nucleotide changes present in a variant polynucleotide may be silent, which means that they do not alter the amino acids encoded by the polynucleotide. However, nucleotide changes may also result in amino acid substitutions, additions, deletions, fusions and truncations in the polypeptide encoded by the reference sequence. The substitutions, deletions or additions may involve one or more nucleotides. The variants may be altered in coding or non-coding regions or both. Alterations in the coding regions may produce conservative or non-conservative amino acid substitutions, deletions or additions. In the context of the present invention, particularly preferred embodiments are those in which the polynucleotides encode polypeptides which retain substantially the same biological function or activity as the mature 12-LO protein, or those in which the polynucleotides encode polypeptides which maintain or increase a particular biological activity, while reducing a second biological activity. A polynucleotide fragment is a polynucleotide having a sequence that is entirely the same as part but not all of a given nucleotide sequence, preferably the nucleotide sequence of a 12-LO gene, and variants thereof. The fragment can be a portion of an exon or of an intron of a 12-LO gene. It can also be a portion of the regulatory regions of the 12-LO gene preferably of the promoter sequence of the 12-LO gene. Such fragments may be "free-standing", i.e. not part of or fused to other polynucleotides, or they may be comprised within a single larger polynucleotide of which they form a part or region. Indeed, several of these fragments may be present within a single larger polynucleotide.

Identity between Nucleic Acids and Polypeptides

The terms "percentage of sequence identity" and "percentage homology" are used interchangeably herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Homology is evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, *Proc. Natl. Acad. Sci.* 85(8):2444–2448, 1988; Altschul et al., *J. Mol. Biol.* 215(3):403–410,1990; Thompson et al., *Nucleic Acids Res.* 22(2):4673–4680, 1994; Higgins et al., *Methods Enzymol.* 266:383–402, 1996; Altschul et al., *Nature Genetics* 3:266–272, 1993, the disclosures of which are incorporated herein by reference in their entireties). In a particularly preferred embodiment, protein and nucleic acid sequence homologies are evaluated using the Basic Local Alignment Search Tool ("BLAST") which is well known in the art (See, e.g., Karlin and Altschul,. *Proc. Natl. Acad. Sci. USA* 87:2267–2268, 1990; Altschul et al., *J. Mol. Biol.* 215(3):403–410, 1990; Altschul et al., *Nature Genetics* 3:266–272, 1993; Altschul et al., *Nuc. Acids Res.* 25:3389–3402, 1997, the disclosures of which are incorporated herein by reference in their entireties). In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., *Science* 256:1443–1445, 1992; Henikoff and Henikoff, *Proteins* 17:49–61, 1993, the disclosures of which are incorporated herein by reference in their entireties). Less preferably, the PAM or PAM250 matrices may also be used (See, e.g., Schwartz and Dayhoff, eds., *Matrices for Detecting Distance Relationships: Atlas of Protein Sequence and Structure, Washington:National Biomedical Research Foundation*, 1978, the disclosure of which is incorporated herein by reference in its entirety). The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, *Proc. Natl. Acad. Sci. USA* 87:2267–2268, 1990, the disclosure of which is incorporated herein by reference in its entirety).

Stringent Hybridization Conditions

By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in prehybridization mixture containing 100 µg/ml denatured salmon sperm DNA and 5–20× $10^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. Other conditions of high stringency which may be used are well known in the art and as cited in Sambrook et al., 1989; and Ausubel et al., 1989. These hybridization conditions are suitable for a nucleic acid molecule of about 20 nucleotides in length. There is no need to say that the hybridization conditions described above are to be adapted according to the length of the desired nucleic acid, following techniques well-known to one skilled in the art. The suitable hybridization conditions may for example be adapted according to the teachings disclosed in the book of Hames and Higgins (*NucleicAcid Hybridization: A Practical Approach*, IRL Press, Oxford, 1985) or in Sambrook et al. (*Molecular Cloning: A Laboratory Manual*, $2^{nd}$ edition, Cold Spring Harbor Laboratory, Cold Spring Harbor, N.Y., 1989), the disclosures of which are incorporated herein by reference in their entireties.

I. Biallelic Markers and Polynucleotides Comprising Biallelic Markers

A. Polynucleotides of the Present Invention

The present invention encompasses polynucleotides for use as primers and probes in the methods of the invention. These polynucleotides may consist of, consist essentially of, or comprise a contiguous span of nucleotides of a sequence from any sequence in the Sequence Listing as well as sequences which are complementary thereto ("complements thereof"). The "contiguous span" may be at least 8, 10, 12, 15, 18, 20, 25, 35, 40, 50, 70, 80, 100, 250, 500 or 1000 nucleotides in length, to the extent that a contiguous span of these lengths is consistent with the lengths of the particular Sequence ID. It should be noted that the polynucleotides of the present invention are not limited to having the exact flanking sequences surrounding the polymorphic bases, which are enumerated in the Sequence Listing. Rather, it will be appreciated that the flanking sequences surrounding the biallelic markers, or any of the primers of probes of the invention which, are more distant from the markers, may be lengthened or shortened to any extent compatible with their intended use and the present invention specifically contemplates such sequences. It will be appreciated that the polynucleotides referred to in the Sequence Listing may be of any length compatible with their intended use. Also the flanking regions outside of the contiguous span need not be homologous to native flanking sequences which actually occur in human subjects. The addition of any nucleotide sequence, which is compatible with the nucleotides intended use is specifically contemplated. The contiguous span may optionally include the eicosanoid-related biallelic marker in said sequence. Biallelic markers generally consist of a polymorphism at one single base position. Each biallelic marker therefore corresponds to two forms of a polynucleotide sequence which, when compared with one another, present a nucleotide modification at one position. Usually, the nucleotide modification involves the substitution of one nucleotide for another. Optionally either the original or the alternative allele of the biallelic markers disclosed in Table 9, or the first or second allele disclosed in Tables 8 and 10 may be specified as being present at the eicosanoid-related biallelic marker. Optionally, the biallelic markers may be specified as 12-214-85, 12-215-272, 12-221-163, 12-225-82, 10-234-179, 10-235-272, 10-251-342, 10-395-367, 12-730-58, 12-735-208, 12-739-22, 12-540-363, 12-550-206, 10-207-410, 10-171-254, 12-94-110, 12-834-290, 10-55-115, 12-857-122, 12-872-175, 12-882-40, 12-888-234, 12-278-353, 12-283-386, 12-44-181, 10-343-231, 10-349-216, 10-509-295, 10-511-337, 10-349-216, 10-343-231, 10-13-396, 12-570-62, 10-474-320, 10-510-173 and 10-342-301 which consist of more complex polymorphisms including insertions/deletions of at least one nucleotide. Optionally either the original or the alternative allele of these biallelic markers may be specified as being present at the eicosanoid-related biallelic marker. Preferred polynucleotides may consist of, consist essentially of, or comprise a contiguous span of nucleotides of a sequence from SEQ ID No 571–595, 600, 606, 613, 620, 628, and 638–639; or more preferably from SEQ ID No 1225–1249, 1254, 1260, 1267, 1274, 1282, 1292 and 1293 as well as sequences which are complementary thereto. The "contiguous span" may be at least 8, 10, 12, 15, 18, 20, 25, 35, 40, 50, 70, 80, 100, 250, 500 or 1000 nucleotides in length, to the extent that a contiguous span of these lengths is consistent with the lengths of the particular Sequence ID. The contiguous span may optionally comprise a biallelic marker selected from the group consisting of biallelic markers 12-214-85, 12-215-272, 12-221-163, 12-225-82, 10-234-179, 10-235-272, 10-251-342, 10-395-367, 12-730-58, 12-735-208, 12-739-22, 12-540-363, 12-550-206, 10-207-410, 10-171-254, 12-94-110, 12-834-290, 10-55-115, 12-857-122, 12-872-175, 12-882-40, 12-888-234, 12-278-353, 12-283-386, 12-44-181, 10-343-231, 10-349-216, 10-509-295, 10-511-337, 10-349-216, 10-343-231, 10-13-396, 12-570-62, 10-474-320, 10-510-173 and 10-342-301.

The invention also relates to polynucleotides that hybridize, under conditions of high or intermediate stringency, to a polynucleotide of a sequence from any sequence in the Sequence Listing as well as sequences, which are complementary thereto. Preferably such polynucleotides are at least 20, 25, 35, 40, 50, 70, 80, 100, 250, 500 or 1000 nucleotides in length, to the extent that a polynucleotide of these lengths is consistent with the lengths of the particular Sequence ID. Preferred polynucleotides comprise an eicosanoid-related biallelic marker. Optionally either the original or the alternative allele of the biallelic markers disclosed in Table 10 may be specified as being present at the eicosanoid-related biallelic marker. Conditions of high and intermediate stringency are further described in III.C.4 "Methods of Genotyping DNA Samples for Biallelic Markers-Hybridization assay methods."

The preferred polynucleotides of the invention include the sequence ranges included in any one the sequence ranges of Tables 8, 11, and 14 individually or in groups consisting of all the possible combinations of the ranges of included in Tables 8, 11, and 14. The preferred polynucleotides of the invention also include fragments of at least 8, 10, 12, 15, 18, 20, 25, 35, 40, 50, 70, 80, 100, 250, 500 or 1000 consecutive nucleotides of the sequence ranges included in any one of the sequence ranges of Tables 8, 11, and 14 to the extent that fragments of these lengths are consistent with the lengths of the particular sequence range. The preferred polynucleotides of the invention also include fragments of at least 8, 10, 12, 15, 18, 20, 25, 35, 40, 50, 70, 80, 100, 250, 500 or 1000 consecutive nucleotides of the sequence complementary to the sequence ranges included in any one of the sequence ranges of Tables 8, 11, and 14 to the extent that fragments of these lengths are consistent with the lengths of the particular sequence range.

Particularly preferred polynucleotides of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No 651, wherein said contiguous span comprises at least 1, 2, 3, 4, 5 or 10 of the following nucleotide positions of SEQ ID No. 651:1 to 2584, 4425 to 5551, 5634 to 5757, 5881 to 5995, 6100 to 6348, 6510 to 7378, 7523 to 8644, 8855 to 12253, 12341 to12853, 13024 to 13307, 13430 to 16566, 16668 to 16774, 16946 to 17062, 17555 to 20674; and the complements thereof. Other particularly preferred polynucleotides of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides from a sequence of SEQ ID No. 651 and the complements thereof; wherein said contiguous span comprises at least one nucleotide positions selected from the group consisting of: a C at position 3355, a G at position 3488, a G at position 3489, and a G at position 3708 of SEQ ID No. 651.

Additional preferred polynucleotides of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides from a sequence of SEQ ID No. 652, wherein said contiguous span comprises a T at position 1205 of SEQ ID No. 652 or nucleotide positions 2151 to 2157of SEQ ID No. 652; and the complements thereof.

The present invention further embodies isolated, purified, and recombinant polynucleotides which encode polypeptides comprising a contiguous span of at least 6 amino acids, preferably at least 8 to 10 amino acids, more preferably at least 12, 15, 20, 25, 30, 40, 50, or 100 amino acids of SEQ ID No. 653, wherein said contiguous span comprises at least one amino acid position selected from the group consisting of the following: an His residue et amino acid position 189, an His residue at amino acid position 225, a Cys residue at amino acid position 243, an Arg residue at amino acid position 261, an Asn residue at amino acid position 322, an Arg residue at amino acid position 337, a Asn residue at amino acid position 362, an Asn at amino acid position 568 and a Lys residue at amino acid position 574. The present invention further provides isolated, purified, and recombinant polynucleotides which encode polypeptides comprising a contiguous span of at least 6 amino acids, preferably at least 8 to 10 amino acids, more preferably at least 12, 15, 20, 25, 30, 40, 50, or 100 amino acids of SEQ ID No. 653, wherein said contiguous span comprises at least one of amino acid positions 110–131 of SEQ ID No. 653.

Particularly preferred polynucleotides of the present invention include purified, isolated or recombinant polynucleotides comprising a contiguous span of at least 12, 15, 18, 20, 25, 30, 35, 40, 50, 60, 70, 80, 90, 100, 150, 200, 500, or 1000 nucleotides of a sequence selected from the group consisting of SEQ ID Nos. 26–68, 614–646, and 651–652; or more preferably from SEQ ID No 651–652, 680–722, and 1268–1300, or the complements thereof, wherein said span includes a 12-lipoxygenase-related biallelic marker. Optionally said biallelic marker is selected from the biallelic markers described in Table 2(a–c) and even more preferably said biallelic marker is selected from biallelic markers: 12-197-244, 12-208-35, 12-226-167, 12-206-366, 10-346-141, 10-347-111, 10-347-165, 10-347-203, 10-347-220, 10-349-97, 10-349-224, 10-341-116, 12-196-119, 12-214-129, 12-216-421, 12-219-230, and 12-223-207. Optionally either allele of the biallelic markers described above in the definition of 12-lipoxygenase-related biallelic marker is specified as being present at the 12-lipoxygenase-related biallelic marker.

Particularly preferred polynucleotides of the present invention include purified, isolated or recombinant polynucleotides comprising a contiguous span of at least 12, 15, 18, 20, 25, 30, 35, 40, 50, 60, 70, 80, 90, 100, 150, 200, 500, or 1000 nucleotides of a sequence of SEQ ID No. 651 and the complements thereof; wherein said contiguous span comprises a least one nucleotide positions selected from the group consisting of: a T at position 2323, a C at position 2341, an A at position 2623, an A at position 2832, a C at position 2844, an A at position 2934, an A at position 2947, a G at position 3802, a G at position 4062, a C at position 4088, a T at position 4109, a T at position 4170, an A at position 6019, a C at position 6375, a C at position 6429, an A at position 6467, a G at position 6484, an A at position 8658, a G at position 8703, an A at position 8777, a G at position 8785, a G at position 13341, an A at position 16836, an A at position 16854, and a T at position 17355 of SEQ ID No. 651.

Particularly preferred polynucleotides of the present invention include purified, isolated or recombinant polynucleotides comprising a contiguous span of at least 12, 15, 18, 20, 25, 30, 35, 40, 50, 60, 70, 80, 90, 100, 150, 200, 500, or 1000 nucleotides of a sequence of SEQ ID No. 652 and the complements thereof; wherein said contiguous span comprises a least one nucleotide position selected from the group consisting of: G at position 366, an A at position 605, a C at position 712, a T at position 766, an A at position 804, a G at position 821, an A at position 1004, a G at position 1049, an A at position 1123, a G at position 1131, a G at position 1491, an A at position 1742, an A at position 1760, an A at position 1941, and a T at position 2144 of SEQ ID No. 652.

Table 2(a–c) contains a list of preferred 12-LO-related biallelic markers. Each marker is described by indicating its Marker ID, the position of the marker in the SEQ ID and the two most common alleles.

TABLE 2a

| NON-GENOMIC BIALLELIC MARKERS | | | | | |
|---|---|---|---|---|---|
| | | POSITION OF BIALLELIC MARKER IN SEQ ID (FIG. 2A) | | POSITION OF BIALLELIC MARKER IN SEQ ID (FIG. 2B) | |
| BIALLELIC MARKER ID | ALLELES | SEQ ID No. | Position | SEQ ID No | Position |
| 12-196-119 | C/T | 44 | 119 | 698 | 24 |
| 12-197-244 | C/T | 45 | 243 | 699 | 24 |
| 12-198-128 | A/G | 46 | 128 | 700 | 24 |
| 12-208-35 | A/T | 48 | 35 | 702 | 24 |
| 12-214-129 | C/T | 49 | 129 | 703 | 24 |
| 12-214-151 | G/C | 50 | 151 | 704 | 24 |
| 12-214-360 | C/G | 51 | 358 | 705 | 24 |

TABLE 2a-continued

| NON-GENOMIC BIALLELIC MARKERS | | | | | |
|---|---|---|---|---|---|
| | | POSITION OF BIALLELIC MARKER IN SEQ ID (FIG. 2A) | | POSITION OF BIALLELIC MARKER IN SEQ ID (FIG. 2B) | |
| BIALLELIC MARKER ID | ALLELES | SEQ ID No. | Position | SEQ ID No | Position |
| 12-214-85 | Deletion CCTAT | 571 | 85 | 1225 | 24 |
| 12-215-272 | Deletion T | 572 | 271 | 1226 | 24 |
| 12-215-467 | G/T | 52 | 466 | 706 | 24 |
| 12-216-421 | A/G | 53 | 418 | 707 | 24 |
| 12-219-230 | A/G | 54 | 229 | 708 | 24 |
| 12-219-256 | C/T | 55 | 255 | 709 | 24 |
| 12-221-163 | GTCCTA/T | 573 | 163 | 1227 | 24 |
| 12-221-302 | A/C | 57 | 302 | 711 | 24 |
| 12-223-179 | A/G | 58 | 179 | 712 | 24 |
| 12-223-207 | C/T | 59 | 207 | 713 | 24 |
| 12-225-541 | C/T | 60 | 540 | 714 | 24 |
| 12-225-82 | Deletion T | 574 | 82 | 1228 | 24 |
| 12-226-167 | C/G | 61 | 166 | 715 | 24 |
| 12-226-458 | C/T | 62 | 455 | 716 | 24 |
| 12-229-332 | G/C | 63 | 332 | 717 | 24 |
| 12-229-351 | G/C | 64 | 351 | 718 | 24 |
| 12-230-364 | C/T | 65 | 364 | 719 | 24 |
| 12-231-100 | C/T | 66 | 99 | 720 | 24 |
| 12-231-148 | C/T | 67 | 147 | 721 | 24 |
| 12-231-266 | C/T | 68 | 265 | 722 | 24 |

TABLE 2b

| BIALLELIC MARKERS IN GENOMIC SEQUENCE (SEQ ID No. 651) | | |
|---|---|---|
| BIALLELIC MARKER ID | ALLELES | POSITION OF BIALLELIC MARKER IN SEQ ID |
| 10-508-191 | C/T | 1128 |
| 10-508-245 | C/T | 1182 |
| 10-510-173 | ATTTA/TTTTTT | 1827 |
| 10-511-62 | C/T | 2048 |
| 10-511-337 | Insertion of T | 2323 |
| 10-512-36 | G/C | 2341 |
| 10-512-318 | A/G | 2623 |
| 10-513-250 | A/G | 2832 |
| 10-513-262 | C/T | 2844 |
| 10-513-352 | A/G | 2934 |
| 10-513-365 | A/G | 2947 |
| 12-206-81 | A/G | 3802 |
| 10-343-231 | Deletion of C | 4062 |
| 12-206-366 | C/T | 4088 |
| 10-343-278 | C/T | 4109 |
| 10-343-339 | G/T | 4170 |
| 10-346-23 | A/G | 5903 |
| 10-346-141 | A/G | 6019 |
| 10-346-263 | G/C | 6141 |
| 10-346-305 | C/T | 6183 |
| 10-347-74 | A/G | 6338 |
| 10-347-111 | G/C | 6375 |
| 10-347-165 | C/T | 6429 |
| 10-347-203 | A/G | 6467 |
| 10-347-220 | A/G | 6484 |
| 10-347-271 | A/T | 6534 |
| 10-347-348 | A/G | 6611 |
| 10-348-391 | A/G | 7668 |
| 10-349-47 | C/T | 8608 |
| 10-349-97 | A/G | 8658 |
| 10-349-142 | G/C | 8703 |
| 10-349-216 | Deletion of CTG | 8777 |
| 10-349-224 | G/T | 8785 |
| 10-349-368 | C/T | 8926 |
| 10-350-72 | C/T | 12171 |
| 10-350-332 | C/T | 12429 |
| 10-507-170 | A/G | 13341 |

TABLE 2b-continued

BIALLELIC MARKERS IN GENOMIC SEQUENCE (SEQ ID No. 651)

| BIALLELIC MARKER ID | ALLELES | POSITION OF BIALLELIC MARKER IN SEQ ID |
|---|---|---|
| 10-507-321 | A/C | 13492 |
| 10-507-353 | C/T | 13524 |
| 10-507-364 | C/T | 13535 |
| 10-507-405 | C/T | 13576 |
| 12-220-48 | G/A | 15194 |
| 10-339-32 | C/T | 16468 |
| 10-339-124 | C/T | 16559 |
| 10-340-112 | A/C | 16836 |
| 10-340-130 | A/T | 16854 |
| 10-340-238 | A/G | 16962 |
| 10-341-116 | A/G | 17152 |
| 10-341-319 | C/T | 17355 |
| 10-342-301 | Insertion of A | 17623 |
| 10-342-373 | C/T | 17695 |

TABLE 2c

BIALLELIC MARKERS IN 12-LO cDNA (SEQ ID No 652)

| BIALLELIC MARKER ID | ALLELES | POSITION OF BIALLELIC MARKER IN SEQ ID |
|---|---|---|
| 10-343-231 | Deletion of C | 366 |
| 10-346-141 | A/G | 605 |
| 10-347-111 | G/C | 712 |
| 10-347-165 | C/T | 766 |
| 10-347-203 | A/G | 804 |
| 10-347-220 | A/G | 821 |
| 10-349-142 | G/C | 1049 |
| 10-349-216 | Deletion of CTG | 1123 |
| 10-349-224 | G/T | 1131 |
| 10-507-170 | A/G | 1491 |
| 10-340-112 | A/C | 1742 |
| 10-340-130 | A/T | 1760 |
| 10-341-116 | A/G | 1941 |
| 10-341-319 | C/T | 2144 |

The primers of the present invention may be designed from the disclosed sequences for any method known in the art. A preferred set of primers is fashioned such that the 3' end of the contiguous span of identity with the sequences of the Sequence Listing is present at the 3' end of the primer. Such a configuration allows the 3' end of the primer to hybridize to a selected nucleic acid sequence and dramatically increases the efficiency of the primer for amplification or sequencing reactions. In a preferred set of primers the contiguous span is found in one of the sequences described in Table 11. Allele specific primers may be designed such that a biallelic marker is at the 3' end of the contiguous span and the contiguous span is present at the 3' end of the primer. Such allele specific primers tend to selectively prime an amplification or sequencing reaction so long as they are used with a nucleic acid sample that contains one of the two alleles present at a biallelic marker. The 3' end of primers of the invention may be located within or at least 2, 4, 6, 8, 10, 12, 15, 18, 20, 25, 50, 100, 250, 500, or 1000, to the extent that this distance is consistent with the particular Sequence ID, nucleotides upstream of an eicosanoid-related biallelic marker in said sequence or at any other location which is appropriate for their intended use in sequencing, amplification or the location of novel sequences or markers. A list of preferred amplification primers is disclosed in Table 13. A more preferred set of amplification primers is described in Table 13 in SEQ ID Nos. 26–70, 72–418, 425–489, 491–530, 532–539, 541–646, and 651–652. Primers with their 3' ends located 1 nucleotide upstream of an eicosanoid-related biallelic marker have a special utility as microsequencing assays. Preferred microsequencing primers are described in Table 12. A more preferred set of microsequencing primers is described in Table 12 in SEQ ID Nos. 26–70, 72–418, 425–489, 491–530, 532–539, 541–646, and 651–652.

The probes of the present invention may be designed from the disclosed sequences for any method known in the art, particularly methods which allow for testing if a particular sequence or marker disclosed herein is present. A preferred set of probes may be designed for use in the hybridization assays of the invention in any manner known in the art such that they selectively bind to one allele of a biallelic marker, but not the other under any particular set of assay conditions. Preferred hybridization probes may consists of, consist essentially of, or comprise a contiguous span which ranges in length from 8, 10, 12, 15, 18 or 20 to 25, 35, 40, 50, 60, 70, or 80 nucleotides, or be specified as being 12, 15, 18, 20, 25, 35, 40, or 50 nucleotides in length and including an eicosanoid-related biallelic marker of said sequence. Optionally the original allele or alternative allele disclosed in Tables 9 and 10 may be specified as being present at the biallelic marker site. Optionally, said biallelic marker may be within 6, 5, 4, 3, 2, or 1 nucleotides of the center of the hybridization probe or at the center of said probe. A particularly preferred set of hybridization probes is disclosed in Table 14 or a sequence complementary thereto.

Any of the polynucleotides of the present invention can be labeled, if desired, by incorporating a label detectable by spectroscopic, photochemical, biochemical, immunochemical, or chemical means. For example, useful labels include radioactive substances, fluorescent dyes or biotin. Preferably, polynucleotides are labeled at their 3' and 5' ends. A label can also be used to capture the primer, so as to facilitate the immobilization of either the primer or a primer extension product, such as amplified DNA, on a solid support. A capture label is attached to the primers or probes and can be a specific binding member which forms a binding pair with the solid's phase reagent's specific binding member (e.g. biotin and streptavidin). Therefore depending upon the type of label carried by a polynucleotide or a probe, it may be employed to capture or to detect the target DNA. Further, it will be understood that the polynucleotides, primers or probes provided herein, may, themselves, serve as the capture label. For example, in the case where a solid phase reagent's binding member is a nucleic acid sequence, it may be selected such that it binds a complementary portion of a primer or probe to thereby immobilize the primer or probe to the solid phase. In cases where a polynucleotide probe itself serves as the binding member, those skilled in the art will recognize that the probe will contain a sequence or "tail" that is not complementary to the target. In the case where a polynucleotide primer itself serves as the capture label, at least a portion of the primer will be free to hybridize with a nucleic acid on a solid phase. DNA Labeling techniques are well known to the skilled technician.

Any of the polynucleotides, primers and probes of the present invention can be conveniently immobilized on a solid support. Solid supports are known to those skilled in the art and include the walls of wells of a reaction tray, test tubes, polystyrene beads, magnetic beads, nitrocellulose strips, membranes, microparticles such as latex particles, sheep (or other animal) red blood cells, duracytes® and others. The solid support is not critical and can be selected by one skilled in the art. Thus, latex particles, microparticles, magnetic or non-magnetic beads, membranes, plastic tubes, walls of microtiter wells, glass or silicon chips, sheep (or other suitable animal's) red blood cells and duracytes are all suitable examples. Suitable methods for immobilizing nucleic acids on solid phases include ionic, hydrophobic, covalent interactions and the like. A solid support, as used herein, refers to any material which is insoluble, or can be made insoluble by a subsequent reaction. The solid support can be chosen for its intrinsic ability to attract and immobilize the capture reagent. Alternatively, the solid phase can retain an additional receptor which has the ability to attract and immobilize the capture reagent. The additional receptor can include a charged substance that is oppositely charged with respect to the capture reagent itself or to a charged substance conjugated to the capture reagent. As yet another alternative, the receptor molecule can be any specific binding member which is immobilized upon (attached to) the solid support and which has the ability to immobilize the capture reagent through a specific binding reaction. The receptor molecule enables the indirect binding of the capture reagent to a solid support material before the performance of the assay or during the performance of the assay. The solid phase thus can be a plastic, derivatized plastic, magnetic or non-magnetic metal, glass or silicon surface of a test tube, microtiter well, sheet, bead, microparticle, chip, sheep (or other suitable animal's) red blood cells, duracytes® and other configurations known to those of ordinary skill in the art. The polynucleotides of the invention can be attached to or immobilized on a solid support individually or in groups of at least 2, 5, 8, 10, 12, 15, 20, or 25 distinct polynucleotides of the inventions to a single solid support. In addition, polynucleotides other than those of the invention may be attached to the same solid support as one or more polynucleotides of the invention.

Any polynucleotide provided herein may be attached in overlapping areas or at random locations on the solid support. Alternatively the polynucleotides of the invention may be attached in an ordered array wherein each polynucleotide is attached to a distinct region of the solid support which does not overlap with the attachment site of any other polynucleotide. Preferably, such an ordered array of polynucleotides is designed to be "addressable" where the distinct locations are recorded and can be accessed as part of an assay procedure. Addressable polynucleotide arrays typically comprise a plurality of different oligonucleotide probes that are coupled to a surface of a substrate in different known locations. The knowledge of the precise location of each polynucleotides location makes these "addressable" arrays particularly useful in hybridization assays. Any addressable array technology known in the art can be employed with the polynucleotides of the invention. One particular embodiment of these polynucleotide arrays is known as the Genechips™, and has been generally described in U.S. Pat. No. 5,143,854; PCT publications WO 90/15070 and 92/10092. These arrays may generally be produced using mechanical synthesis methods or light directed synthesis methods, which incorporate a combination of photolithographic methods and solid phase oligonucleotide synthesis (Fodor et al., *Science*, 251:767–777, 1991). The immobilization of arrays of oligonucleotides on solid supports has been rendered possible by the development of a technology generally identified as "Very Large Scale Immobilized Polymer Synthesis" (VLSIPS™) in which, typically, probes are immobilized in a high density array on a solid surface of a chip. Examples of VLSIPS™ technologies are provided in U.S. Pat. Nos. 5,143,854 and 5,412,087 and in PCT Publications WO 90/15070, WO 92/10092 and WO 95/11995, which describe methods for forming oligonucleotide arrays through techniques such as light-directed synthesis techniques. In designing strategies aimed at providing arrays of nucleotides immobilized on solid supports, further presentation strategies were developed to order and display the oligonucleotide arrays on the chips in an attempt to maximize hybridization patterns and sequence information. Examples of such presentation strategies are disclosed in PCT Publications WO 94/12305, WO 94/11530, WO 97/29212 and WO 97/31256.

Oligonucleotide arrays may comprise at least one of the sequences selected from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof or a fragment thereof of at least 8, 10, 12, 15, 18, 20, 25, 35, 40, 50, 70, 80, 100, 250, 500 or 1000 consecutive nucleotides, to the extent that fragments of these lengths is consistent with the lengths of the particular Sequence ID, for determining whether a sample contains one or more alleles of the biallelic markers of the present invention. Oligonucleotide arrays may also comprise at least one of the sequences selected from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof, or more preferably from SEQ ID Nos. 651–652, 680–724, 726–1072, 1079–1143, 1145–1184, 1186–1193, and 1195–1300, and the complements thereof or a fragment thereof of at least 8, 10, 12, 15, 18, 20, 25, 35, 40, 50, 70, 80, 100, 250, 500 or 1000 consecutive nucleotides, to the extent that fragments of these lengths is consistent with the lengths of the particular Sequence ID, for amplifying one or more alleles of the biallelic markers of Table 7(A–B). In other embodiments, arrays may also comprise at least one of the sequences selected from the group consisting of SEQ ID Nos. 1–70, 72–418, 425–489, 491–530, 532–539, and 541–652, and the complements thereof; preferably SEQ ID Nos. 651–652, 655–724, 726–1072, 1079–1143, 1145–1184, 1186–1193, and 1195–1304, and the complements thereof; or more preferably from SEQ ID Nos. 651–652, 680–724, 726–1072, 1079–1143, 1145–1184, 1186–1193, and 1195–1300, and the complements thereof or a fragment thereof of at least 8, 10, 12, 15, 18, 20, 25, 35, 40, 50, 70, 80, 100, 250, 500 or 1000 consecutive nucleotides, to the extent that fragments of these lengths is consistent with the lengths of the particular Sequence ID, for conducting microsequencing analyses to determine whether a sample contains one or more alleles of the biallelic markers of the invention. In still further embodiments, the oligonucleotide array may comprise at least one of the sequences selecting from the group consisting of SEQ ID Nos. 26–70, 72–418, 425–489, 491–530, 532–539, 541–646, and 651–652, or more preferably from SEQ ID Nos. 651–652, 680–724, 726–1072, 1079–1143, 1145–1184, 1186–1193, and 1195–1300; and the sequences complementary thereto or a fragment thereof of at least 8, 10, 12, 15, 18, 20, 25, 35, 40, 50, 70, 80, 100, 250, 500 or 1000 nucleotides in length, to the extent that fragments of these lengths is consistent with the lengths of the particular Sequence ID, for determining whether a sample contains one or more alleles of the biallelic markers of the present invention. In still further embodiments, the oligonucleotide array may comprise at least one of the novel sequences listed in the fifth column of Table 8 or the sequences complementary thereto or a fragment comprising at least 8, 10, 12, 15, 18, 20, 25, 35, 40, 50, 70, 80, 100, 250, 500 or 1000 consecutive nucleotides thereof to the extent that fragments of these lengths are consistent with the lengths of the particular novel sequences.

The present invention also encompasses diagnostic kits comprising one or more polynucleotides of the invention, optionally with a portion or all of the necessary reagents and instructions for genotyping a test subject by determining the identity of a nucleotide at an eicosanoid-related biallelic marker. The polynucleotides of a kit may optionally be attached to a solid support, or be part of an array or addressable array of polynucleotides. The kit may provide for the determination of the identity of the nucleotide at a marker position by any method known in the art including, but not limited to, a sequencing assay method, a microsequencing assay method, a hybridization assay method, an allele specific amplification method, or a mismatch detection assay based on polymerases and/or ligases. Optionally such a kit may include instructions for scoring the results of the determination with respect to the test subjects' risk of contracting a diseases involving arachidonic acid metabolism, or likely response to an agent acting on arachidonic acid metabolism, or chances of suffering from side effects to an agent acting on arachidonic acid metabolism. Preferably such a kit may include instructions for scoring the results of the determination with respect to the subjects risk of developing hepatotoxicity upon treatment with the antiasthmatic drug zileuton.

B. Genomic Sequences of the 12-LO Gene and Biallelic Markers

The present invention encompasses the genomic sequence of the 12-LO gene of SEQ ID No. 651. The 12-LO genomic sequences comprise exons and introns. Particularly preferred genomic sequences of the 12-LO gene include isolated, purified, or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No. 651, wherein said contiguous span comprises at least 1 one of the following nucleotide positions of SEQ ID No. 651: 1 to 2584,4425 to 5551, 5634 to 5757, 5881 to 5995, 6100 to 6348, 6510 to 7378, 7523 to 8644, 8855 to 12253, 12341 to12853, 13024 to 13307, 13430 to 16566, 16668 to 16774, 16946 to 17062, 17555 to 20674; and the complements thereof. The nucleic acids defining the 12-LO intronic polynucleotides may be used as oligonucleotide primers or probes in order to detect the presence of a copy of the 12-LO gene in a test sample, or alternatively in order to amplify a target nucleotide sequence within the12-LO sequences. Other particularly preferred genomic sequences of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides from a sequence of SEQ ID No. 651 and the complements thereof; wherein said contiguous span comprises at least one nucleotide positions selected from the group consisting of: a C at position 3355, a G at position 3488, a G at position 3489, and a G at position 3708 of SEQ ID No. 651.

The present invention further provides 12-lipoxygenase intron and exon polynucleotide sequences including biallelic markers. Particularly preferred polynucleotides of the present invention include purified, isolated or recombinant polynucleotides comprising a contiguous span of at least 12, 15, 18, 20, 25, 30, 35, 40, 50, 60, 70, 80, 90, 100, 150, 200, 500, or 1000 nucleotides of a sequence of SEQ ID No. 651 or the complements thereof, wherein said span includes a 12-lipoxygenase-related biallelic marker. Optionally said biallelic marker is selected from the biallelic markers described in Table 2(a–c) and even more preferably said biallelic marker is selected from biallelic markers: 12-197-244, 12-208-35, 12-226-167, 12-206-366, 10-346-141, 10-346-141, 10-347-111, 10-347-165, 10-347-203, 10-347-220, 10-349-97, 10-349-224, 10-341-116, 12-196-119, 12-214-129, 12-216-421, 12-219-230, and 12-223-207. Particularly preferred genomic sequences of the present invention include purified, isolated or recombinant polynucleotides comprising a contiguous span of at least 12, 15, 18, 20, 25, 30, 35, 40, 50, 60, 70, 80, 90, 100, 150, 200, 500, or 1000 nucleotides of a sequence of SEQ ID No. 651 and the complements thereof, wherein said contiguous span comprises a least one nucleotide positions selected from the group consisting of: a T at position 2323, a C at position 2341, an A at position 2623, an A at position 2832, a C at position 2844, an A at position 2934, an A at position 2947, a G at position 3802, a G at position 4062, a C at position 4088, a T at position 4109, a T at position 4170, an A at position 6019, a C at position 6375, a C at position 6429, an A at position 6467, a G at position 6484, an A at position 8658, a G at position 8703, an A at position 8777, a G at position 8785, a G at position 13341, an A at position 16836, an A at position 16854, and a T at position 17355 of SEQ ID No. 651.

The genomic sequence of the 12-LO gene contains regulatory sequences both in the non-coding 5'-flanking region and in the non-coding 3'-flanking region that border the 12-LO transcribed region containing the 14 exons of this gene. 5'-regulatory sequences of the 12-LO gene comprise the polynucleotide sequences located between the nucleotide in position 1 and the nucleotide in position 3124 of the nucleotide sequence of SEQ ID No. 651, more preferably between positions 1 and 2195 of SEQ ID No. 651. 3'-regulatory sequences of the 12-LO gene comprise the polynucleotide sequences located between the nucleotide in position 17555 and the nucleotide in position 20674 of the nucleotide sequence of SEQ ID No. 651.

The promoter activity of the regulatory regions contained in the 12-LO gene of polynucleotide sequence of SEQ ID No. 651 can be assessed by any known method. Methods for identifying the polynucleotide fragments of SEQ ID No. 651 involved in the regulation of the expression of the 12-LO gene are well-known to those skilled in the art (see Sambrook et al., *Molecular Cloning A Laboratory Manual*, $2^{nd}$ edition, Cold Spring Harbor Laboratory, Cold Spring Harbor, N.Y., 1989). An example of a typical method, that can be used, involves a recombinant vector carrying a reporter gene and genomic sequences from the 12-LO genomic sequence of SEQ ID No. 651. Briefly, the expression of the reporter gene (for example beta galactosidase or chloramphenicol acetyl transferase) is detected when placed under the control of a biologically active polynucleotide fragment. Genomic sequences located upstream of the first exon of the 12-LO gene may be cloned into any suitable promoter reporter vector, such as the pSEAP-Basic, pSEAP-Enhancer, pβgal-Basic, pβgal-Enhancer, or pEGFP-1 Promoter Reporter vectors available from Clontech, or pGL2-basic or pGL3-basic promoterless luciferase reporter gene vector from Promega. Each of these promoter reporter vectors include multiple cloning sites positioned upstream of a reporter gene encoding a readily assayable protein such as secreted alkaline phosphatase, luciferase, beta galactosidase, or green fluorescent protein. The sequences upstream the first 12-LO exon are inserted into the cloning sites upstream of the reporter gene in both orientations and introduced into an appropriate host cell. The level of reporter protein is assayed and compared to the level obtained with a vector lacking an insert in the cloning site. The presence of an elevated expression level in the vector containing the insert with respect to the control vector indicates the presence of a promoter in the insert.

Promoter sequences within the 5' non-coding regions of the 12-LO gene may be further defined by constructing nested 5' and/or 3' deletions using conventional techniques such as Exonuclease III or appropriate restriction endonuclease digestion. The resulting deletion fragments can be inserted into the promoter reporter vector to determine whether the deletion has reduced or obliterated promoter activity, such as described, for example, by Coles et al. (*Hum. Mol. Genet.*, 7:791–800, 1998, the disclosure of which is incorporated herein by reference in its entirety). In this way, the boundaries of the promoters may be defined. If desired, potential individual regulatory sites within the promoter may be identified using site directed mutagenesis or linker scanning to obliterate potential transcription factor binding sites within the promoter individually or in combination. The effects of these mutations on transcription levels may be determined by inserting the mutations into cloning sites in promoter reporter vectors. This type of assays are well known to those skilled in the art and are further described in WO 97/17359, U.S. Pat. No. 5,374,544, EP 582 796, U.S. Pat. Nos. 5,698,389, 5,643,746, 5,502,176, and 5,266,488, the disclosures of which are incorporated herein by reference in their entireties.

The activity and the specificity of the promoter of the 12-LO gene can further be assessed by monitoring the expression level of a detectable polynucleotide operably linked to the 12-LO promoter in different types of cells and tissues. The detectable polynucleotide may be either a polynucleotide that specifically hybridizes with a predefined oligonucleotide probe, or a polynucleotide encoding a detectable protein, including a 12-LO polypeptide or a fragment or a variant thereof. This type of assay is well known to those skilled in the art and is described in U.S. Pat. Nos. 5,502,176, and 5,266,488, the disclosures of which are incorporated herein by reference in their entireties.

Polynucleotides carrying the regulatory elements located both at the 5' end and at the 3' end of the 12-LO coding region may be advantageously used to control the transcriptional and translational activity of a heterologous polynucleotide of interest, said polynucleotide being heterologous as regards to the 12-LO regulatory region.

Thus, the present invention also concerns a purified, isolated, and recombinant nucleic acid comprising a polynucleotide which, is selected from the group consisting of, the polynucleotide sequences located between the nucleotide in position 1 and the nucleotide in position 3124 of the nucleotide sequence of SEQ ID No. 651, more preferably between positions 1 and 2195 of SEQ ID No. 651 and the polynucleotide sequences located between the nucleotide in position 17555 and the nucleotide in position 20674 of SEQ ID No. 651; or a sequence complementary thereto or a biologically active fragment thereof.

A "biologically active" fragment of SEQ ID No. 651 according to the present invention is a polynucleotide comprising or alternatively consisting of a fragment of said polynucleotide which is functional as a regulatory region for expressing a recombinant polypeptide or a recombinant polynucleotide in a recombinant cell host.

For the purpose of the invention, a nucleic acid or polynucleotide is "functional" as a regulatory region for expressing a recombinant polypeptide or a recombinant polynucleotide if said regulatory polynucleotide contains nucleotide sequences which contain transcriptional and translational regulatory information, and such sequences are "operably linked" to nucleotide sequences which encode the desired polypeptide or the desired polynucleotide.

The regulatory polynucleotides according to the invention may be advantageously part of a recombinant expression vector that may be used to express a coding sequence in a desired host cell or host organism.

A further object of the invention consists of an isolated polynucleotide comprising:

a) a nucleic acid comprising a regulatory nucleotide sequence selected from the group consisting of a nucleotide sequence comprising a polynucleotide of SEQ ID No. 651;

b) a polynucleotide encoding a desired polypeptide or a nucleic acid of interest, operably linked to the nucleic acid defined in (a) above.

The polypeptide encoded by the nucleic acid described above may be of various nature or origin, encompassing proteins of prokaryotic or eukaryotic origin. Among the polypeptides expressed under the control of a 12-LO regulatory region, there may be cited bacterial, fungal or viral antigens. Also encompassed are eukaryotic proteins such as intracellular proteins, for example "house keeping" proteins, membrane-bound proteins, for example receptors, and secreted proteins, for example cytokines. In a specific embodiment, the desired polypeptide may be the 12-LO protein, especially the protein of the amino acid sequence of SEQ ID No. 653 and 654.

The desired nucleic acids encoded by the above described polynucleotide, usually a RNA molecule, may be complementary to a desired coding polynucleotide, for example to the 12-LO coding sequence, and thus useful as an antisense polynucleotide. Such a polynucleotide may be included in a recombinant expression vector in order to express the desired polypeptide or the desired nucleic acid in host cell or in a host organism.

C. cDNA Sequences of the 12-LO Gene and Biallelic Markers

The present invention provides a 12-lipoxygenase cDNA of SEQ ID No. 652. The Open Reading Frame encoding the 12-LO protein spans from the nucleotide in position 40 to the nucleotide in position 2028 of the polynucleotide sequence of SEQ ID No. 652. The cDNA of SEQ ID No. 652 also includes a 5'-UTR region (1–40) and a 3'-UTR (2028–2343) region.

Additional preferred cDNA polynucleotides of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides from a sequence of SEQ ID No. 652 and the complements thereof. Additional preferred polynucleotides include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides from a sequence of SEQ ID No. 652, wherein said contiguous span comprises a T at position 1205 of SEQ ID No. 652 or nucleotide positions 2151 to 2157 of SEQ ID No. 652; and the complements thereof.

Preferred cDNA fragments comprise a biallelic marker selected from the group consisting of 10-343-231, 10-346-141, 10-347-111, 10-347-165, 10-347-203, 10-347-220, 10-349-97, 10-349-142, 10-349-216, 10-349-224, 10-507-170, 10-340-112, 10-340-130, 10-341-116 and 10-341-319. Some biallelic polymorphisms represent silent nucleotide substitutions but biallelic markers 10-346-141, 10-347-111, 10-347-165, 10-347-220, 10-349-97, 10-349-142, 10-349-216, 10-340-112, 10-340-130 are associated with amino acid changes in the corresponding 12-lipoxygenase polypeptide. One allele of biallelic marker 10-343-231 (polymorphic deletion of a C nucleotide at position 366 of SEQ ID No. 652) causes a frame shift in the open reading frame of the 12-LO cDNA of SEQ ID No. 652 resulting in the novel polypeptide of SEQ ID No. 653. 12-LO polypeptides of SEQ ID Nos. 653 and 654 of the present invention are further described below.

Other preferred cDNA fragments comprise a contiguous span of at least 12, 15, 18, 20, 25, 30, 35, 40, 50, 60, 70, 80, 90, 100, 150, 200, 500, or 1000 nucleotides from a sequence of SEQ ID No. 652, wherein said contiguous span comprises a T at position 1205 of SEQ ID No. 652; and the complements thereof. 12-LO cDNA fragments comprise a contiguous span of at least 12, 15, 18, 20, 25, 30, 35, 40, 50, 60, 70, 80, 90, 100, 150, 200, 500, or 1000 nucleotides from a sequence of SEQ ID No. 652, wherein said contiguous span comprises a T at position 1205 of SEQ ID No. 652 encode novel 12-LO polypeptides of SEQ ID No. 653 comprising a contiguous span of at least 6 amino acids, preferably at least 8 to 10 amino acids, more preferably at least 12, 15, 20, 25, 30, 40, 50, or 100 amino acids of SEQ ID No. 653, wherein said contiguous span comprises a Leu residue at amino acid position 389 of SEQ ID No. 653.

The polynucleotide disclosed above that contains the coding sequence of the 12-LO gene of the invention may be expressed in a desired host cell or a desired host organism, when this polynucleotide is placed under the control of suitable expression signals. The expression signals may be either the expression signals contained in the regulatory regions in the 12-LO gene of the invention or may be exogenous regulatory nucleic sequences. Such a polynucleotide, when placed under the suitable expression signals, may also be inserted in a vector for its expression.

Another preferred cDNA fragment comprises the 5'-UTR (5'regulatory sequence) region beginning at position 1 and ending at position 39 of SEQ ID No. 652. Another preferred cDNA fragment comprises the 3'-UTR (3'regulatory sequence) region beginning at position 2029 and ending at position 2343 of SEQ ID No. 652. Preferably said 3'-UTR region comprises biallelic marker 10-341-319 or nucleotide positions 2151 to 2157of SEQ ID No. 652.

D. Polynucleotide Constructs, Recombinant Vectors, Host Cells and Transgenic Animals The terms "polynucleotide construct" and "recombinant polynucleotide" are used interchangeably herein to refer to linear or circular, purified or isolated polynucleotides that have been artificially designed and which comprise at least two nucleotide sequences that are not found as contiguous nucleotide sequences in their initial natural environment.

Polynucleotide Constructs

1. DNA Constructs for Expressing the 12-LO Gene in Recombinant Host Cells and in Transgenic Animals.

In order to study the physiological and phenotype consequences of a lack of synthesis of the 12-LO protein, both at the cellular level and at the multicellular organism level, in particular as regards to disorders related to abnormal cell proliferation, notably cancers, the invention also encompasses DNA constructs and recombinant vectors enabling a conditional expression of a specific allele of the 12-LO genomic sequence or cDNA A first preferred DNA construct is based on the tetracycline resistance operon tet from *E. coli* transposon Tn110 for controlling the 12-LO gene expression, such as described by Gossen et al. (*Science*, 268:1766–1769, 1995, the disclosure of which is incorporated herein by reference in its entirety). Such a DNA construct contains seven tet operator sequences from Tn10 (tetop) that are fused to either a minimal promoter or a 5'-regulatory sequence of the 12-LO gene, said minimal promoter or said 12-LO regulatory sequence being operably linked to a polynucleotide of interest that codes either for a sense or an antisense oligonucleotide or for a polypeptide, including a 12-LO polypeptide or a peptide fragment thereof. This DNA construct is functional as a conditional expression system for the nucleotide sequence of interest when the same cell also comprises a nucleotide sequence coding for either the wild type (tTA) or the mutant (rTA) repressor fused to the activating domain of viral protein VP16 of herpes simplex virus, placed under the control of a promoter, such as the HCMVIE1 enhancer/promoter or the MMTV-LTR. Indeed, a preferred DNA construct of the invention will comprise both the polynucleotide containing the tet operator sequences and the polynucleotide containing a sequence coding for the tTA or the rTA repressor. In the specific embodiment wherein the conditional expression DNA construct contains the sequence encoding the mutant tetracycline repressor rTA, the expression of the polynucleotide of interest is silent in the absence of tetracycline and induced in its presence.

2. DNA Constructs Allowing Homologous Recombination: Replacement Vectors.

A second preferred DNA construct will comprise, from 5'-end to 3'-end: (a) a first nucleotide sequence that is comprised in the 12-LO genomic sequence; (b) a nucleotide sequence comprising a positive selection marker, such as the marker for neomycine resistance (neo); and (c) a second nucleotide sequence that is comprised in the 12-LO genomic sequence, and is located on the genome downstream the first 12-LO nucleotide sequence (a).

In a preferred embodiment, this DNA construct also comprises a negative selection marker located upstream the nucleotide sequence (a) or downstream the nucleotide sequence (c). Preferably, the negative selection marker consists of the thymidine kinase (tk) gene (Thomas et al., *Cell*, 44:419–428, 1986, the disclosure of which is incorporated herein by reference in its entirety), the hygromycine beta gene (Te Riele et al., *Nature*, 348:649–651, 1990, the disclosure of which is incorporated herein by reference in its entirety), the hprt gene (Van der Lugt et al., *Gene*, 105:263–267, 1991; Reid et al., *Proc. Natl. Acad. Sci. USA*, 87:4299–4303, 1990, the disclosures of which are incorporated herein by reference in their entireties) or the Diphteria toxin A fragment (Dt-A) gene (Nada et al., *Cell*, 73:1125–1135, 1993; Yagi et al., *Proc. Natl; Acad. Sci. USA*, 87:9918–9922, 1990, the disclosures of which are incorporated herein by reference in their entireties). Preferably, the positive selection marker is located within a 12-LO exon sequence so as to interrupt the sequence encoding a 12-LO protein.

These replacement vectors are further described by Mansour et al. (*Nature*, 336:348–352, 1988, the disclosure of which is incorporated herein by reference in its entirety) and Koller et al. (*Ann. Rev. Immunol.*, 10:705–730, 1992, the disclosure of which is incorporated herein by reference in its entirety).

The first and second nucleotide sequences (a) and (c) may be indifferently located within a 12-LO regulatory sequence, an intronic sequence, an exon sequence or a sequence containing both regulatory and/or intronic and/or exon sequences. The size of the nucleotide sequences (a) and (c) is ranging from 1 to 50 kb, preferably from 1 to 10 kb, more preferably from 2 to 6 kb and most preferably from 2 to 4 kb.

3. DNA Constructs Allowing Homologous Recombination: Cre-loxP System.

These new DNA constructs make use of the site specific recombination system of the P1 phage. The P1 phage possesses a recombinase called Cre which, interacts specifically with a 34 base pairs loxP site. The loxP site is composed of two palindromic sequences of 13 bp separated by a 8 bp conserved sequence (Hoess et al., *Nucleic Acids Res.*, 14:2287–2300, 1986, the disclosure of which is incorporated herein by reference in its entirety). The recombination by the Cre enzyme between two loxP sites having an identical orientation leads to the deletion of the DNA fragment.

The Cre-loxP system used in combination with a homologous recombination technique was first described by Gu et al. (*Cell.* 73:1155–1164, 1993, the disclosure of which is incorporated herein by reference in its entirety). Briefly, a nucleotide sequence of interest to be inserted in a targeted location of the genome harbors at least two loxP sites in the same orientation and located at the respective ends of a nucleotide sequence to be excised from the recombinant genome. The excision event requires the presence of the recombinase (Cre) enzyme within the nucleus of the recombinant cell host. The recombinase enzyme may be brought at the desired time either by (a) incubating the recombinant cell hosts in a culture medium containing this enzyme, by injecting the Cre enzyme directly into the desired cell, such as described by Araki et al. (*Proc. Natl; Acad. Sci. USA*, 92: 160–164, 1995, the disclosure of which is incorporated herein by reference in its entirety), or by lipofection of the enzyme into the cells, such as described by Baubonis et al. (*Nucleic Acids Res.*, 21:2025–2029, 1993, the disclosure of which is incorporated herein by reference in its entirety); (b) transfecting the cell host with a vector comprising the Cre coding sequence operably linked to a promoter functional in the recombinant cell host, which promoter being optionally inducible, said vector being introduced in the recombinant cell host, such as described by Gu et al. (*Cell*, 73:1155–1164, 1993, the disclosure of which is incorporated herein by reference in its entirety) and Sauer et al. (*Proc. Natl; Acad. Sci. USA*, 85:5166–5170, 1988, the disclosure of which is incorporated herein by reference in its entirety); (c) introducing in the genome of the cell host a polynucleotide comprising the Cre coding sequence operably linked to a promoter functional in the recombinant cell host, which promoter is optionally inducible, and said polynucleotide being inserted in the genome of the cell host either by a random insertion event or an homologous recombination event, such as described by Gu et al. (*Science*, 265:103–106, 1994, the disclosure of which is incorporated herein by reference in its entirety).

In the specific embodiment wherein the vector containing the sequence to be inserted in the 12-LO gene by homologous recombination is constructed in such a way that selectable markers are flanked by loxP sites of the same orientation, it is possible, by treatment by the Cre enzyme, to eliminate the selectable markers while leaving the 12-LO sequences of interest that have been inserted by an homologous recombination event. Again, two selectable markers are needed: a positive selection marker to select for the recombination event and a negative selection marker to select for the homologous recombination event. Vectors and methods using the Cre-loxP system are further described by Zou et al. (*Curr. Biol.*, 4:1099–1103, 1994), the disclosure of which is incorporated herein by reference in its entirety.

Thus, a third preferred DNA construct of the invention comprises, from 5'-end to 3'-end: (a) a first nucleotide sequence that is comprised in the 12-LO genomic sequence; (b) a nucleotide sequence comprising a polynucleotide encoding a positive selection marker, said nucleotide sequence comprising additionally two sequences defining a site recognized by a recombinase, such as a loxP site, the two sites being placed in the same orientation; and (c) a second nucleotide sequence that is comprised in the 12-LO genomic sequence, and is located on the genome downstream of the first 12-LO nucleotide sequence (a).

The sequences defining a site recognized by a recombinase, such as a loxP site, are preferably located within the nucleotide sequence (b) at suitable locations bordering the nucleotide sequence for which the conditional excision is sought. In one specific embodiment, two loxP sites are located at each side of the positive selection marker sequence, in order to allow its excision at a desired time after the occurrence of the homologous recombination event.

In a preferred embodiment of a method using the third DNA construct described above, the excision of the polynucleotide fragment bordered by the two sites recognized by a recombinase, preferably two loxP sites, is performed at a desired time, due to the presence within the genome of the recombinant cell host of a sequence encoding the Cre enzyme operably linked to a promoter sequence, preferably an inducible promoter, more preferably a tissue-specific promoter sequence and most preferably a promoter sequence which is both inducible and tissue-specific, such as described by Gu et al. (*Science*, 265:103–106, 1994), the disclosure of which is incorporated herein by reference in its entirety.

The presence of the Cre enzyme within the genome of the recombinant cell host may result of the breeding of two transgenic animals, the first transgenic animal bearing the 12-LO-derived sequence of interest containing the loxP sites as described above and the second transgenic animal bearing the Cre coding sequence operably linked to a suitable promoter sequence, such as described by Gu et al. (*Science*, 265:103–106, 1994), the disclosure of which is incorporated herein by reference in its entirety.

Spatio-temporal control of the Cre enzyme expression may also be achieved with an adenovirus based vector that contains the Cre gene thus allowing infection of cells, or in vivo infection of organs, for delivery of the Cre enzyme, such as described by Anton et al. (*J. Virol.*, 69:4600–4606, 1995) and Kanegae et al. (*Nucleic Acids Res.*, 23:3816–3821, 1995), the disclosures of which are incorporated herein by reference in their entireties.

The DNA constructs described above may be used to introduce a desired nucleotide sequence of the invention, preferably a 12-LO genomic sequence or a 12-LO cDNA sequence, and by most preferably an altered copy of a 12-LO genomic or cDNA sequence, within a predetermined location of the targeted genome, leading either to the generation of an altered copy of a targeted gene (knock-out homologous recombination) or to the replacement of a copy of the targeted gene by another copy sufficiently homologous to allow an homologous recombination event to occur (knock-in homologous recombination).

Recombinant Vectors

The term "vector" is used herein to designate either a circular or a linear DNA or RNA molecule, which is either double-stranded or single-stranded, and which comprise at least one polynucleotide of interest that is sought to be transferred in a cell host or in a unicellular or multicellular host organism.

The present invention encompasses a family of recombinant vectors that comprise a regulatory polynucleotide derived from the 12-LO genomic sequence, or a coding polynucleotide from the 12-LO genomic sequence. Consequently, the present invention further deals with a recombinant vector comprising either a regulatory polynucleotide comprised in the nucleic acid of SEQ ID No. 651 or a polynucleotide comprising the 12-LO coding sequence or both.

In a first preferred embodiment, a recombinant vector of the invention is used to amplify the inserted polynucleotide derived from a 12-LO genomic sequence selected from the group consisting of the nucleic acids of SEQ ID No. 651 or a 12-LO cDNA, for example the cDNA of SEQ ID No. 652 in a suitable host cell, this polynucleotide being amplified each time the recombinant vector replicates. Generally, a recombinant vector of the invention may comprise any of the polynucleotides described herein, including regulatory sequences and coding sequences, as well as any 12-LO primer or probe as defined above.

In a second preferred embodiment, recombinant vectors of the invention consist of expression vectors comprising either a regulatory polynucleotide or a coding nucleic acid of the invention, or both. Within certain embodiments, expression vectors are employed to express the 12-LO polypeptide which can be then purified and, for example be used in ligand screening assays or as an immunogen in order to raise specific antibodies directed against the 12-LO protein. In other embodiments, the expression vectors are used for constructing transgenic animals and also for gene therapy. Expression requires that appropriate signals are provided in the vectors, said signals including various regulatory elements, such as enhancers/promoters from both viral and mammalian sources that drive expression of the genes of interest in host cells. Dominant drug selection markers for establishing permanent, stable cell clones expressing the products are generally included in the expression vectors of the invention, as they are elements that link expression of the drug selection markers to expression of the polypeptide.

More particularly, the present invention relates to expression vectors which include nucleic acids encoding a 12-LO protein, preferably the 12-LO protein of the amino acid sequence of SEQ ID No. 653, under the control of a regulatory sequence selected among the12-LO regulatory polynucleotides of SEQ ID Nos. 651 and 652, or alternatively under the control of an exogenous regulatory sequence.

Consequently, preferred expression vectors of the invention are selected from the group consisting of: (a) the 12-LO regulatory sequence comprised therein drives the expression of a coding polynucleotide operably linked thereto; (b) the 12-LO coding sequence is operably linked to regulation sequences allowing its expression in a suitable cell host and/or host organism.

Additionally, the recombinant expression vector described above may also comprise a nucleic acid comprising a 5'-regulatory polynucleotide, preferably a 5'-regulatory polynucleotide of the 12-LO gene. Additionally, the recombinant expression vector described above may also comprise a nucleic acid comprising a 3'-regulatory polynucleotide, preferably a 3'-regulatory polynucleotide of the 12-LO gene. The 12-LO 3'-regulatory polynucleotide may also comprise the 3'-UTR sequence contained in the nucleotide sequence of SEQ ID No. 652. The 5'-regulatory polynucleotide may also include the 5'-UTR sequence of the 12-LO cDNA, or a biologically active fragment or variant thereof. The invention also pertains to a recombinant expression vector useful for the expression of the 12-LO coding sequence, wherein said vector comprises a nucleic acid of SEQ ID No. 652.

The invention also relates to a recombinant expression vector comprising a nucleic acid comprising the nucleotide sequence beginning at the nucleotide in position 40 and ending in position 2028 of the polynucleotide of SEQ ID No. 652.

Some of the elements which can be found in the vectors of the present invention are described in further detail in the following sections.

1. General Features of the Expression Vectors of the Invention.

A recombinant vector according to the invention comprises, but is not limited to, a YAC (Yeast Artificial Chromosome), a BAC (Bacterial Artificial Chromosome), a phage, a phagemid, a cosmid, a plasmid or even a linear DNA molecule which may consist of a chromosomal, non-chromosomal, semi-synthetic and synthetic DNA. Such a recombinant vector can comprise a transcriptional unit comprising an assembly of:

(1) a genetic element or elements having a regulatory role in gene expression, for example promoters or enhancers. Enhancers are cis-acting elements of DNA, usually from about 10 to 300 bp in length that act on the promoter to increase the transcription.

(2) a structural or coding sequence which is transcribed into mRNA and eventually translated into a polypeptide, said structural or coding sequence being operably linked to the regulatory elements described in (1); and (3) appropriate transcription initiation and termination sequences. Structural units intended for use in yeast or eukaryotic expression systems preferably include a leader sequence enabling extracellular secretion of translated protein by a host cell. Alternatively, when a recombinant protein is expressed without a leader or transport sequence, it may include a N-terminal residue. This residue may or may not be subsequently cleaved from the expressed recombinant protein to provide a final product.

Generally, recombinant expression vectors will include origins of replication, selectable markers permitting transformation of the host cell, and a promoter derived from a highly expressed gene to direct transcription of a downstream structural sequence. The heterologous structural sequence is assembled in appropriate phase with translation initiation and termination sequences, and preferably a leader sequence capable of directing secretion of the translated protein into the periplasmic space or the extracellular medium. In a specific embodiment wherein the vector is adapted for transfecting and expressing desired sequences in mammalian host cells, preferred vectors will comprise an origin of replication in the desired host, a suitable promoter and enhancer, and also any necessary ribosome binding sites, polyadenylation site, splice donor and acceptor sites, transcriptional termination sequences, and 5'-flanking non-transcribed sequences. DNA sequences derived from the SV40 viral genome, for example SV40 origin, early promoter, enhancer, splice and polyadenylation sites may be used to provide the required non-transcribed genetic elements.

The in vivo expression of a 12-LO polypeptide of SEQ ID Nos. 653 and 654 may be useful in order to correct a genetic defect related to the expression of the native gene in a host organism or to the production of a biologically inactive 12-LO protein.

Consequently, the present invention also deals with recombinant expression vectors mainly designed for the in vivo production of the 12-LO polypeptide of SEQ I) Nos.

653–654 or fragments or variants thereof by the introduction of the appropriate genetic material in the organism of the patient to be treated. This genetic material may be introduced in vitro in a cell that has been previously extracted from the organism, the modified cell being subsequently reintroduced in the said organism, directly in vivo into the appropriate tissue.

2. Regulatory Elements.

The suitable promoter regions used in the expression vectors according to the present invention are chosen taking into account the cell host in which the heterologous gene has to be expressed. The particular promoter employed to control the expression of a nucleic acid sequence of interest is not believed to be important, so long as it is capable of directing the expression of the nucleic acid in the targeted cell. Thus, where a human cell is targeted, it is preferable to position the nucleic acid coding region adjacent to and under the control of a promoter that is capable of being expressed in a human cell, such as, for example, a human or a viral promoter.

A suitable promoter may be heterologous with respect to the nucleic acid for which it controls the expression or alternatively can be endogenous to the native polynucleotide containing the coding sequence to be expressed. Additionally, the promoter is generally heterologous with respect to the recombinant vector sequences within which the construct promoter/coding sequence has been inserted.

Promoter regions can be selected from any desired gene using, for example, CAT (chloramphenicol transferase) vectors and more preferably pKK232–8 and pCM7 vectors.

Preferred bacterial promoters are the LacI, LacZ, the T3 or T7 bacteriophage RNA polymerase promoters, the gpt, lambda PR, PL and trp promoters (EP 0036776, the disclosure of which is incorporated herein by reference in its entirety), the polyhedrin promoter, or the p10 protein promoter from baculovirus (Kit Novagen) (Smith et al., *Mol. Cell. Biol.* 3:2156–2165, 1983; O'Reilly et al., *Baculovirus Expression Vectors: A Laboratory Manual.*, W.H. Freeman and Co., New York, 1992, the disclosures of which are incorporated herein by reference in their entireties), the lambda PR promoter or also the trc promoter.

Eukaryotic promoters include CMV immediate early, HSV thymidine kinase, early and late SV40, LTRs from retrovirus, and mouse metallothionein-L. Selection of a convenient vector and promoter is well within the level of ordinary skill in the art. The choice of a promoter is well within the ability of a person skilled in the field of genetic egineering. For example, one may refer to the book of Sambrook et al. (*Molecular Cloning: A Laboratory Manual*, 2nd edition, Cold Spring Harbor Laboratory, Cold Spring Harbor, N.Y., 1989), the disclosure of which is incorporated herein by reference in its entirety.

Where a cDNA insert is employed, one will typically desire to include a polyadenylation signal to effect proper polyadenylation of the gene transcript. The nature of the polyadenylation signal is not believed to be crucial to the successful practice of the invention, and any such sequence may be employed such as human growth hormone and SV40 polyadenylation signals. Also contemplated as an element of the expression cassette is a terminator. These elements can serve to enhance message levels and to minimize read through from the cassette into other sequences.

The vector containing the appropriate DNA sequence as described above, more preferably 12-LO gene regulatory polynucleotide, a polynucleotide encoding the 12-LO polypeptide of SEQ ID Nos. 653 and 654 or both of them, can be utilized to transform an appropriate host to allow the expression of the desired polypeptide or polynucleotide.

3. Selectable Markers.

Such markers would confer an identifiable change to the cell permitting easy identification of cells containing the expression construct. The selectable marker genes for selection of transformed host cells are preferably dihydrofolate reductase or neomycin resistance for eukaryotic cell culture, TRP1 for *S. cerevisiae* or tetracycline, rifampicin or ampicillin resistance in *E. coli*, or levan saccharase for mycobacteria, this latter marker being a negative selection marker.

4. Preferred Vectors.

As a representative but non-limiting example, useful expression vectors for bacterial use can comprise a selectable marker and a bacterial origin of replication derived from commercially available plasmids comprising genetic elements of pBR322 (ATCC 37017). Such commercial vectors include, for example, pKK223-3 (Pharmacia, Uppsala, Sweden), and GEM1 (Promega Biotec, Madison, Wis., USA). Large numbers of other suitable vectors are known to those of skill in the art, and commercially available, such as the following bacterial vectors : pQE70, pQE60, pQE-9 (Qiagen), pbs, pD10, phagescript, psiX174, pbluescript SK, pbsks, pNH8A, pNH16A, pNH18A, pNH46A (Stratagene); ptrc99a, pKK223-3, pKK233-3, pDR540, pRIT5 (Pharmacia); pWLNEO, pSV2CAT, pOG44, pXTI, pSG (Stratagene); pSVK3, pBPV, pMSG, pSVL (Pharmacia); pQE-30 (QIAexpress).

The P1 bacteriophage vector may contain large inserts ranging from about 80 to about 100 kb. The construction of P1 bacteriophage vectors such as p158 or p158/neo8 are described by Sternberg (*Mamm. Genome*, 5:397–404, 1994), the disclosure of which is incorporated herein by reference in its entirety. Recombinant P1 clones comprising 12-LO nucleotide sequences may be designed for inserting large polynucleotides of more than 40 kb (Linton et al., *J. Clin. Invest.*, 92:3029–3037, 1993), the disclosure of which is incorporated herein by reference in its entirety. To generate P1 DNA for transgenic experiments, a preferred protocol is the protocol described by McCormick et al. (*Genet. Anal. Tech. Appl.*, 11:158–164, 1994). Briefly, *E. coli* (preferably strain NS3529) harboring the P1 plasmid are grown overnight in a suitable broth medium containing 25 µg/ml of kanamycin. The P1 DNA is prepared from the *E. coli* by alkaline lysis using the Qiagen Plasmid Maxi kit (Qiagen, Chatsworth, Calif., USA), according to the manufacturer's instructions. The P1 DNA is purified from the bacterial lysate on two Qiagen-tip 500 columns, using the washing and elution buffers contained in the kit. A phenol/chloroform extraction is then performed before precipitating the DNA with 70% ethanol. After solubilizing the DNA in TE (10 mM Tris-HCl, pH 7.4, 1 mM EDTA), the concentration of the DNA is assessed by spectrophotometry.

When the goal is to express a P1 clone comprising 12-LO nucleotide sequences in a transgenic animal, typically in transgenic mice, it is desirable to remove vector sequences from the P1 DNA fragment, for example by cleaving the P1 DNA at rare-cutting sites within the P1 polylinker (SfiI, NotI or SalI). The P1 insert is then purified from vector sequences on a pulsed-field agarose gel, using methods similar using methods similar to those originally reported for the isolation of DNA from YACs (Schedl et al., *Nature* 362:258–261 1993; Peterson et al., *Proc. Natl. Acad. Sci. USA* 90:7593–7597, 1993, the disclosures of which are incorporated herein by reference in their entireties). At this stage, the resulting purified insert DNA can be concentrated, if necessary, on a Millipore Ultrafree-MC Filter Unit (Millipore, Bedford, Mass., USA—30,000 molecular weight limit) and then dialyzed against microinjection buffer (10 mM Tris-HCl, pH 7.4; 250 µM EDTA) containing 100 mM NaCl, 30 µM spermine, 70 µM spermidine on a microdyalisis membrane (type VS, 0.025 µM from Millipore). The intactness of the purified P1 DNA insert is assessed by electrophoresis on 1% agarose (Sea Kem GTG; FMC Bioproducts) pulse-field gel and staining with ethidium bromide.

A suitable vector for the expression of the 12-LO polypeptide of SEQ ID Nos. 653 and 654 is a baculovirus vector that can be propagated in insect cells and in insect cell lines. A specific suitable host vector system is the pVL1392/1393 baculovirus transfer vector (Pharmingen) that is used to transfect the SF9 cell line (ATCC N°CRL 1711) which is derived from Spodoptera frugiperda.

Other suitable vectors for the expression of the 12-LO polypeptide of SEQ ID Nos. 653 and 654 in a baculovirus expression system include those described by Chai et al. (Biotech. Appl. Biochem., 18:259–273, 1993), Vlasak et al. (Eur. J. Biochem., 135: 123–126, 1983) and Lenhard et al. (Gene, 169: 187–190, 1996), the disclosures of which are incorporated herein by reference in their entireties.

Retrovirus vectors and adeno-associated virus vectors are generally understood to be the recombinant gene delivery systems of choice for the transfer of exogenous polynucleotides in vivo, particularly to mammals, including humans. These vectors provide efficient delivery of genes into cells, and the transferred nucleic acids are stably integrated into the chromosomal DNA of the host.

Particularly preferred retroviruses for the preparation or construction of retroviral in vitro or in vitro gene delivery vehicles of the present invention include retroviruses selected from the group consisting of Mink-Cell Focus Inducing Virus, Murine Sarcoma Virus, Reticuloendotheliosis virus and Rous Sarcoma virus. Particularly preferred Murine Leukemia Viruses include the 4070A and the 1504A viruses, Abelson (ATCC No. VR-999), Friend (ATCC No. VR-245), Gross (ATCC No. VR-590), Rauscher (ATCC No. VR-998) and Moloney Murine Leukemia Virus (ATCC No. VR-190; PCT Application No. WO 94/24298, the disclosure of which is incorporated herein by reference in its entirety). Particularly preferred Rous Sarcoma Viruses include Bryan high titer (ATCC Nos. VR-334, VR-657, VR-726, VR-659 and VR-728). Other preferred retroviral vectors are those described in Roth et al. (Nature Medicine, 2:985–991, 1996), PCT Application No. WO 93/25234 and PCT Application No. WO 94/06920, the disclosures of which are incorporated herein by reference in their entireties.

Yet another viral vector system that is contemplated by the invention consists in the adeno-associated virus (AAV). The adeno-associated virus is a naturally occurring defective virus that requires another virus, such as an adenovirus or a herpes virus, as a helper virus for efficient replication and a productive life cycle (Muzyczka et al., Current Topics in Microbiol. Immunol., 158:97–129, 1992, the disclosure of which is incorporated herein by reference in its entirety). It is also one of the few viruses that may integrate its DNA into non-dividing cells, and exhibits a high frequency of stable integration (McLaughlin et al., Am. J. Hum. Genet., 59: 561–569, 1989, the disclosure of which is incorporated herein by reference in its entirety). One advantageous feature of AAV derives from its reduced efficacy for transducing primary cells relative to transformed cells.

The bacterial artificial chromosome (BAC) cloning system (Shizuya et al., Proc. Natl. Acad. Sci. U.S.A. 89:8794–8797, 1992, the disclosure of which is incorporated herein by reference in its entirety) has been developed to stably maintain large fragments of genomic DNA (100–300 kb) in E. coli. A preferred BAC vector consists of pBeloBAC11 vector that has been described by Kim et al. (Genomics, 34:213–218,1996), the disclosure of which is incorporated herein by reference in its entirety. BAC libraries are prepared with this vector using size-selected genomic DNA that has been partially digested using enzymes that permit ligation into either the Bam HI or HindIII sites in the vector. Flanking these cloning sites are T7 and SP6 RNA polymerase transcription initiation sites that can be used to generate end probes by either RNA transcription or PCR methods. After the construction of a BAC library in E. coli, BAC DNA is purified from the host cell as a supercoiled circle. Converting these circular molecules into a linear form precedes both size determination and introduction of the BACs into recipient cells. The cloning site is flanked by two Not I sites, permitting cloned segments to be excised from the vector by Not I digestion. Alternatively, the DNA insert contained in the pBeloBAC11 vector may be linearized by treatment of the BAC vector with the commercially available enzyme lambda terminase that leads to the cleavage at the unique cosN site, but this cleavage method results in a full length BAC clone containing both the insert DNA and the BAC sequences.

5. Delivery of the Recombinant Vectors.

In order to effect expression of the polynucleotides and polynucleotide constructs of the invention, these constructs must be delivered into a cell. This delivery may be accomplished in vitro, as in laboratory procedures for transforming cell lines, or in vivo or ex vivo, as in the treatment of certain diseases states. One mechanism is viral infection where the expression construct is encapsidated in an infectious viral particle.

Several non-viral methods for the transfer of polynucleotides into cultured mammalian cells are also contemplated by the present invention, and include, without being limited to, calcium phosphate precipitation (Chen et al., Proc. Natl. Acad. Sci. USA, 94:10756–10761, 1987, the disclosure of which is incorporated herein by reference in its entirety), DEAE-dextran (Gopal, Mol. Cell. Biol., 5:1188–1190, 1985, the disclosure of which is incorporated herein by reference in its entirety), electroporation (Tur-Kaspa et al., Mol. Cell. Biol., 6:716–718, 1986, the disclosure of which is incorporated herein by reference in its entirety), direct microinjection (Harland et al., J. Cell. Biol. 101:1094–1095, 1985), DNA-loaded liposomes (Nicolau et al., Biochim. Biophys. Acta. 721:185–190,1982; Fraley et al., Natl. Acad. Sci. USA 76:3348–3352, 1979, the disclosures of which are incorporated herein by reference in their entireties), and receptor-mediate transfection (Wu and Wu, J. Biol. Chem. 262:4429–4432, 1987; Wu and Wu Biochemistry 27:887–892, 1988, the disclosures of which are incorporated herein by reference in their entireties). Some of these techniques may be successfully adapted for in vivo or ex vivo use.

Once the expression polynucleotide has been delivered into the cell, it may be stably integrated into the genome of the recipient cell. This integration may be in the cognate location and orientation via homologous recombination (gene replacement) or it may be integrated in a random, non-specific location (gene augmentation). In yet further embodiments, the nucleic acid may be stably maintained in the cell as a separate, episomal segment of DNA. Such nucleic acid segments or "episomes" encode sequences sufficient to permit maintenance and replication independent of or in synchronization with the host cell cycle.

One specific embodiment for a method for delivering a protein or peptide to the interior of a cell of a vertebrate in vivo comprises the step of introducing a preparation comprising a physiologically acceptable carrier and a naked polynucleotide operatively coding for the polypeptide of interest into the interstitial space of a tissue comprising the cell, whereby the naked polynucleotide is taken up into the interior of the cell and has a physiological effect. This is particularly applicable for transfer in vitro but it may be applied to in vivo as well.

Compositions for use in vitro and in vivo comprising a "naked" polynucleotide are described in PCT application No. WO 90/11092 (Vical Inc.) and in PCT application No. WO 95/11307, the disclosures of which are incorporated herein by reference in their entireties.

In still another embodiment of the invention, the transfer of a naked polynucleotide of the invention, including a polynucleotide construct of the invention, into cells may be proceeded with a particle bombardment (biolistic), said particles being DNA-coated microprojectiles accelerated to a high velocity allowing them to pierce cell membranes and enter cells without killing them, such as described by Klein et al. (*Nature* 327:70–73, 1987), the disclosure of which is incorporated herein by reference in its entirety.

In a further embodiment, the polynucleotide of the invention may be entrapped in a liposome (Ghosh and Bacchawat, *Targeting of liposomes to hepatocytes, In: Liver Diseases, Targeted diagnosis and therapy using specific rceptors and ligands*, Marcel Dekeker, N.Y., 87–104, 1991; Wong et al., *Gene* 10:87–94, 1980; Nicolau et al., *Biochim. Biophys. Acta.* 721:185–190, 1982, the disclosures of which are incorporated herein by reference in their entireties)

In a specific embodiment, the invention provides a composition for the in vivo production of the 12-LO protein or polypeptide described herein. It comprises a naked polynucleotide operatively coding for this polypeptide, in solution in a physiologically acceptable carrier, and suitable for introduction into a tissue to cause cells of the tissue to express the said protein or polypeptide.

The amount of vector to be injected to the desired host organism varies according to the site of injection. As an indicative dose, it will be injected between 0.1 and 100 μg of the vector in an animal body, preferably a mammal body, for example a mouse body.

In another embodiment of the vector according to the invention, it may be introduced in vitro in a host cell, preferably in a host cell previously harvested from the animal to be treated and more preferably a somatic cell such as a muscle cell. In a subsequent step, the cell that has been transformed with the vector coding for the desired 12-LO polypeptide or the desired fragment thereof is reintroduced into the animal body in order to deliver the recombinant protein within the body either locally or systemically.

Host Cells

Another object of the invention consists of a host cell that have been transformed or transfected with one of the polynucleotides described therein, and more precisely a polynucleotide either comprising a 12-LO regulatory polynucleotide or the coding sequence of the 12-LO polypeptide having the amino acid sequence of SEQ ID Nos. 653 or 654. Are included host cells that are transformed (prokaryotic cells) or that are transfected (eukaryotic cells) with a recombinant vector such as one of those described above.

Generally, a recombinant host cell of the invention comprises any one of the polynucleotides or the recombinant vectors described therein.

A preferred recombinant host cell according to the invention comprises a polynucleotide selected from the following group of polynucleotides:

a) a purified or isolated nucleic acid encoding a 12-LO polypeptide, or a polypeptide fragment or variant thereof.

b) a purified or isolated nucleic comprising at least 8, preferably at least 15, more preferably at least 25, consecutive nucleotides of the nucleotide sequence SEQ ID No. 651, a nucleotide sequence complementary thereto, or a variant thereof.

c) a purified or isolated nucleic acid comprising at least 8 consecutive nucleotides, preferably at least 15, more preferably at least 25 of the nucleotide sequence SEQ ID No. 652, a nucleotide sequence complementary thereto or a variant thereof.

d) a purified or isolated nucleic acid comprising an exon of the 12-LO gene, a sequence complementary thereto or a fragment or a variant thereof.

e) a purified or isolated nucleic acid comprising a combination of at least two exons of the12-LO gene, or the sequences complementary thereto wherein the polynucleotides are arranged within the nucleic acid, from the 5' end to the 3'end of said nucleic acid, in the same order than in SEQ ID No. 651.

f) a purified or isolated nucleic acid comprising the nucleotide sequence SEQ ID No. 651 or the sequences complementary thereto or a biologically active fragment thereof.

g) a polynucleotide consisting of:
   (1) a nucleic acid comprising a regulatory polynucleotide of SEQ ID No. 651 or the sequences complementary thereto or a biologically active fragment thereof
   (2) a polynucleotide encoding a desired polypeptide or nucleic acid.

i) a DNA construct as described previously in the present specification.

Another preferred recombinant cell host according to the present invention is characterized in that its genome or genetic background (including chromosome, plasmids) is modified by the nucleic acid coding for the 12-LO polypeptide of SEQ ID Nos. 653 and 654 or fragments or variants thereof.

Preferred host cells used as recipients for the expression vectors of the invention are the following:

a) Prokaryotic host cells: *Escherichia coli* strains (I.E. DH5-α strain), *Bacillus subtilis, Salmonella typhimurium*, and strains from species like Pseudomonas, Streptomyces and Staphylococcus.

b) Eukaryotic host cells: HeLa cells (ATCC N° CCL2; N° CCL2.1; N° CCL2.2), Cv 1 cells (ATCC N° CCL70), COS cells (ATCC N° CRL1650; N° CRL1651), Sf-9 cells (ATCC N° CRL1711), C127 cells (ATCC N° CRL-1804), 3T3 (ATCC N° CRL-6361), CHO (ATCC N° CCL-61), human kidney 293.(ATCC N° 45504; N° CRL-1573) and BHK (ECACC N° 84100501; N° 84111301)

c) Other mammalian host cells:

The 12-LO gene expression in mammalian, and typically human, cells may be rendered defective, or alternatively it may be proceeded with the insertion of a 12-LO genomic or cDNA sequence with the replacement of the 12-LO gene counterpart in the genome of an animal cell by a 12-LO polynucleotide according to the invention. These genetic alterations may be generated by homologous recombination events using specific DNA constructs that have been previously described.

One kind of host cell that may be used is mammalian zygotes, such as murine zygotes. For example, murine zygotes may undergo microinjection with a purified DNA molecule of interest, such as a purified DNA molecule that has previously been adjusted to a concentration range from 1 ng/ml (for BAC inserts) 3 ng/µl (for P1 bacteriophage inserts) in 10 mM Tris-HCl, pH 7.4, 250 µM EDTA containing 100 mM NaCl, 30 µM spermine, and 70 µM spermidine. When the DNA to be microinjected is relatively large, polyamines and high salt concentrations can be used to avoid mechanical breakage of this DNA, as described by Schedl et al. (*Nucleic Acids Res.* 21:4783–4787, 1993), the disclosure of which is incorporated herein by reference in its entirety.

Anyone of the polynucleotides of the invention, including the DNA constructs described herein, may be introduced in an embryonic stem (ES) cell line, preferably a mouse ES cell line. ES cell lines are derived from pluripotent, uncommitted cells of the inner cell mass of pre-implantation blastocysts. Preferred ES cell lines are the following: ES-E14TG2a (ATCC n° CRL-1821), ES-D3 (ATCC n° CRL1934 and n° CRL-11632), YS001 (ATCC n° CRL-11776), 36.5 (ATCC n° CRL-11116). To maintain ES cells in an uncommitted state, they are cultured in the presence of growth inhibited feeder cells, which provide the appropriate signals to preserve this embryonic phenotype and serve as a matrix for ES cell adherence. Preferred feeder cells consist of primary embryonic fibroblasts that are established from tissue of day 13-day 14 embryos of virtually any mouse strain, that are maintained in culture, such as described by Abbondanzo et al. (*Methods in Enzymology*, Academic Press, New York, 803–823, 1993), the disclosure of which is incorporated herein by reference in its entirety, and are inhibited in growth by irradiation, such as described by Robertson ("Embryo-Derived StemCell Lines," *E. J. Robertson Ed. Teratocarcinomas and Embrionic Stem Cells: A Practical Approach*. IRL Press, Oxford, 71, 1987), the disclosure of which is incorporated herein by reference in its entirety, or by the presence of an inhibitory concentration of LIF, such as described by Pease and Williams (*Exp. Cell. Res.* 190:09–211, 1990), the disclosure of which is incorporated herein by reference in its entirety.

The constructs in the host cells can be used in a conventional manner to produce the gene product encoded by the recombinant sequence.

Following transformation of a suitable host and growth of the host to an appropriate cell density, the selected promoter is induced by appropriate means, such as temperature shift or chemical induction, and cells are cultivated for an additional period.

Cells are typically harvested by centrifugation, disrupted by physical or chemical means, and the resulting crude extract retained for further purification.

Microbial cells employed in the expression of proteins can be disrupted by any convenient method, including freeze-thaw cycling, sonication, mechanical disruption, or use of cell lysing agents. Such methods are well known by the skill artisan.

Transgenic Animals

The terms "transgenic animals" or "host animals" used herein designate animals that have their genome genetically and artificially manipulated so as to include one of the nucleic acids according to the invention. Preferred animals are non-human mammals and include those belonging to a genus selected from Mus (e.g. mice), Rattus (e.g. rats) and Oryctogalus (e.g. rabbits) which have their genome artificially and genetically altered by the insertion of a nucleic acid according to the invention.

The transgenic animals of the invention all include within a plurality of their cells a cloned recombinant or synthetic DNA sequence, more specifically one of the purified or isolated nucleic acids comprising a 12-LO coding sequence, a 12-LO regulatory polynucleotide or a DNA sequence encoding an antisense polynucleotide such as described in the present specification.

Preferred transgenic animals according to the invention contain in their somatic cells and/or in their germ line cells a polynucleotide selected from the following group of polynucleotides:

a) a purified or isolated nucleic acid encoding a 12-LO polypeptide, or a polypeptide fragment or variant thereof.

b) a purified or isolated nucleic comprising at least 8, preferably at least 15, more preferably at least 25, consecutive nucleotides of the nucleotide sequence SEQ ID No. 651, a nucleotide sequence complementary thereto.

c) a purified or isolated nucleic acid comprising at least 8 consecutive nucleotides, preferably at least 15, more preferably at least 25 of the nucleotide sequence SEQ ID No. 652, a nucleotide sequence complementary thereto.

d) a purified or isolated nucleic acid comprising an exon of the 12-LO gene, a sequence complementary thereto or a fragment or a variant thereof.

e) a purified or isolated nucleic acid comprising a combination of at least two exons of the 12-LO gene, or the sequences complementary thereto wherein the polynucleotides are arranged within the nucleic acid, from the 5' end to the 3'end of said nucleic acid, in the same order than in SEQ ID No. 651.

f) a purified or isolated nucleic acid comprising the nucleotide sequence SEQ ID No. 651 or the sequences complementary thereto or a biologically active fragment thereof.

g) a polynucleotide consisting of:
   (1) a nucleic acid comprising a regulatory polynucleotide of SEQ ID No. 651 or the sequences complementary thereto or a biologically active fragment thereof
   (2) a polynucleotide encoding a desired polypeptide or nucleic acid.

i) a DNA construct as described previously in the present specification.

The transgenic animals of the invention thus contain specific sequences of exogenous genetic material such as the nucleotide sequences described above in detail.

In a first preferred embodiment, these transgenic animals may be good experimental models in order to study the diverse pathologies related to cell differentiation, in particular concerning the transgenic animals within the genome of which has been inserted one or several copies of a polynucleotide encoding a native 12-LO protein, or alternatively a mutant 12-LO protein.

In a second preferred embodiment, these transgenic animals may express a desired polypeptide of interest under the control of the regulatory polynucleotides of the 12-LO gene, leading to good yields in the synthesis of this protein of interest, and eventually a tissue specific expression of this protein of interest.

The design of the transgenic animals of the invention may be made according to the conventional techniques well known for one skilled in the art. For more details regarding the production of transgenic animals, and specifically transgenic mice, one may refer to U.S. Pat. Nos. 4,873,191, issued Oct. 10, 1989, U.S. Pat. No. 5,464,764 issued Nov. 7, 1995 and U.S. Pat. No. 5,789,215, issued Aug. 4, 1998, these documents being herein incorporated by reference in their entireties to disclose methods producing transgenic mice.

Transgenic animals of the present invention are produced by the application of procedures which result in an animal with a genome that has incorporated exogenous genetic material. The procedure involves obtaining the genetic material, or a portion thereof, which encodes either a 12-LO coding sequence, a 12-LO regulatory polynucleotide or a DNA sequence encoding a 12-LO antisense polynucleotide such as described in the present specification.

A recombinant polynucleotide of the invention is inserted into an embryonic or ES stem cell line. The insertion is preferably made using electroporation, such as described by Thomas et al. (*Cell* 51:503–512, 1987), the disclosure of which is incorporated herein by reference in its entirety. The cells subjected to electroporation are screened (e.g. by selection via selectable markers, by PCR or by Southern blot analysis) to find positive cells which have integrated the exogenous recombinant polynucleotide into their genome, preferably via an homologous recombination event. An illustrative positive-negative selection procedure that may be used according to the invention is described by Mansour et al. (*Nature* 336:348–352, 1988), the disclosure of which is incorporated herein by reference in its entirety.

Then, the positive cells are isolated, cloned and injected into 3.5 days old blastocysts from mice, such as described by Bradley ("Production and Analysis of Chimaeric Mice," *E. J. Robertson* (Ed.), *Teratocarcinomas and embryonic stem cells: A practical approach* IRL Press, Oxford, 113, 1987), the disclosure of which is incorporated herein by reference in its entirety. The blastocysts are then inserted into a female host animal and allowed to grow to term.

Alternatively, the positive ES cells are brought into contact with embryos at the 2.5 days old 8–16 cell stage (morulae) such as described by Wood et al. (*Proc. Natl. Acad. Sci. U.S.A*. 90:4582–4585, 1993) or by Nagy et al. (*Proc. Natl. Acad. Sci. USA*. 90: 8424–8428, 1993), the disclosures of which are incorporated herein by reference in their entireties, the ES cells being internalized to colonize extensively the blastocyst including the cells which will give rise to the germ line.

The offspring of the female host are tested to determine which animals are transgenic e.g. include the inserted exogenous DNA sequence and which are wild-type. Thus, the present invention also concerns a transgenic animal containing a nucleic acid, a recombinant expression vector or a recombinant host cell according to the invention.

A further object of the invention consists of recombinant host cells obtained from a transgenic animal described herein.

Recombinant cell lines may be established in vitro from cells obtained from any tissue of a transgenic animal according to the invention, for example by transfection of primary cell cultures with vectors expressing onc-genes such as SV40 large T antigen, as described by Chou (*Mol. Endocrinol*. 3:1511–1514, 1989) and Shay et al. (*Biochem. Biophys. Acta*. 1072:1–7, 1991), the disclosures of which are incorporated herein by reference in their entireties.

E. 12-Lipoxygenase Polypeptides

The term "12-LO polypeptides" is used herein to embrace all of the proteins and polypeptides of the present invention. Also forming part of the invention are polypeptides encoded by the polynucleotides of the invention, as well as fusion polypeptides comprising such polypeptides. The invention embodies 12-LO proteins from humans, including isolated or purified 12-LO proteins consisting, consisting essentially, or comprising the sequence of SEQ ID Nos. 653 and 654.

Biallelic markers are associated with amino acid substitutions in the polypeptide sequence of 12-LO. It should be noted the 12-LO proteins of the invention are based on the naturally-occurring variants of the amino acid sequence of human 12-LO; wherein the Arg residue of amino acid position 189 has been replaced with a His residue (biallelic marker 10-346-141), the Asp residue of amino acid position 225 has been replaced with a His residue (biallelic marker 10-347-111), the Arg residue of amino acid position 243 has been replaced with a Cys residue (biallelic marker 10-347-165), the Gln residue of amino acid position 261 has been replaced with an Arg residue (biallelic marker 10-347-220), the Ser residue of amino acid position 322 has been replaced with a Asn residue (biallelic marker 10-349-97), the Pro residue of amino acid position 337 has been replaced with an Arg residue (biallelic marker 10-349-142), the Thr residue of amino acid position 568 has been replaced with an Asn residue (biallelic marker 10-340-112) and wherein the Met residue of amino acid position 574 has been replaced with a Lys residue (biallelic marker 10-340-112). Variant proteins and the fragments thereof which contain amino acid position 189 are collectively referred to herein as "189-His variants." Variant proteins and the fragments thereof which contain amino acid position 225 are collectively referred to herein as "225-His variants." Variant proteins and the fragments thereof which, contain amino acid position 243, are collectively referred to herein as "243-Cys variants." Variant proteins and the fragments thereof which contain amino acid position 261 are collectively referred to herein as "261-Arg variants." Variant proteins and the fragments thereof which contain amino acid position 322 are collectively referred to herein as "322-Asn variants." Variant proteins and the fragments thereof which contain amino acid position 337 are collectively referred to herein as "337-Arg variants." Variant proteins and the fragments thereof which contain amino acid position 568 are collectively referred to herein as "568-Asn variants." Variant proteins and the fragments thereof which contain amino acid position 574 are collectively referred to herein as "574-Lys variants." In each of these amino acid substitutions the original residue is replaced by a non-equivalent amino acid presenting different chemical properties. Therefore, these substitutions cause alterations in the activity, specificity and function of the 12-LO enzyme.

One allele of biallelic marker 10-349-216 is associated with the deletion of a Leu residue at amino acid position 362 of SEQ ID No. 653. 12-LO polypeptides of the present invention also include 12-LO polypeptides wherein the Leu residue at amino acid position 362 of SEQ ID No. 653 has been deleted.

One allele of biallelic marker 10-343-231 is associated with a frameshift in the open reading frame of the 12-LO gene leading to the expression of the variant 12-LO polypeptide of SEQ ID No. 654.

The present invention embodies isolated, purified, and recombinant polypeptides comprising a contiguous span of at least 6 amino acids, preferably at least 8 to 10 amino acids, more preferably at least 12, 15, 20, 25, 30, 40, 50, or 100 amino acids of SEQ ID No. 653, wherein said contiguous span comprises at least one amino acid position selected from the group consisting of: an His residue et amino acid position 189, an His residue at amino acid position 225, a Cys residue at amino acid position 243, an Arg residue at amino acid position 261, an Asn residue at amino acid position 322, an Arg residue at amino acid position 337, a Asn residue at amino acid position 362, an Asn at amino acid position 568 and a Lys residue at amino acid position 574.

The present invention further provides isolated, purified, and recombinant polypeptides comprising a contiguous span of at least 6 amino acids, preferably at least 8 to 10 amino acids, more preferably at least 12, 15, 20, 25, 30, 40, 50, or 100 amino acids of SEQ ID No. 654, wherein said contiguous span comprises at least one of amino acid positions 110–131 of SEQ ID No. 654.

The present invention further embodies isolated, purified, and recombinant polypeptides comprising a contiguous span of at least 6 amino acids, preferably at least 8 to 10 amino acids, more preferably at least 12, 15, 20, 25, 30, 40, 50, or 100 amino acids of SEQ ID No. 653, wherein said contiguous span comprises a Leu residue at amino acid position 389 of SEQ ID No. 653.

In other preferred embodiments the contiguous stretch of amino acids comprises the site of a mutation or functional mutation, including a deletion, addition, swap or truncation of the amino acids in the 12-LO protein sequence.

12-LO proteins are preferably isolated from human or mammalian tissue samples or expressed from human or mammalian genes. The 12-LO polypeptides of the invention can be made using routine expression methods known in the art. The polynucleotide encoding the desired polypeptide is ligated into an expression vector suitable for any convenient host. Both eukaryotic and prokaryotic host systems are used in forming recombinant polypeptides. The polypeptide is then isolated from lysed cells or from the culture medium and purified to the extent needed for its intended use. Purification is by any technique known in the art, for example, differential extraction, salt fractionation, chromatography, centrifugation, and the like. See, for example, *Methods in Enzymology* for a variety of methods for purifying proteins.

In addition, shorter protein fragments are produced by chemical synthesis. Alternatively the proteins of the invention are extracted from cells or tissues of humans or non-human animals. Methods for purifying proteins are known in the art, and include the use of detergents or chaotropic agents to disrupt particles followed by differential extraction and separation of the polypeptides by ion exchange chromatography, affinity chromatography, sedimentation according to density, and gel electrophoresis.

Any 12-LO cDNA, including SEQ ID No. 652, is used to express 12-LO proteins and polypeptides. The nucleic acid encoding the 12-LO protein or polypeptide to be expressed is operably linked to a promoter in an expression vector using conventional cloning technology. The 12-LO insert in the expression vector may comprise the full coding sequence for the 12-LO protein or a portion thereof.

The expression vector is any of the mammalian, yeast, insect or bacterial expression systems known in the art. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon context and codon pairing of the sequence is optimized for the particular expression organism in which the expression vector is introduced, as explained by Hatfield, et al., U.S. Pat. No. 5,082,767, the disclosure of which is incorporated herein by reference in its entirety.

In one embodiment, the entire coding sequence of the 12-LO cDNA through the poly A signal of the cDNA is operably linked to a promoter in the expression vector.

Alternatively, if the nucleic acid encoding a portion of the 12-LO protein lacks a methionine to serve as the initiation site, an initiating methionine can be introduced next to the first codon of the nucleic acid using conventional techniques. Similarly, if the insert from the 12-LO cDNA lacks a poly A signal, this sequence can be added to the construct by, for example, splicing out the Poly A signal from pSG5 (Stratagene) using BglI and SalI restriction endonuclease enzymes and incorporating it into the mammalian expression vector pXT1 (Stratagene). pXT1 contains the LTRs and a portion of the gag gene from Moloney Murine Leukemia Virus. The position of the LTRs in the construct allow efficient stable transfection. The vector includes the Herpes Simplex Thymidine Kinase promoter and the selectable neomycin gene. The nucleic acid encoding the 12-LO protein or a portion thereof is obtained by PCR from a bacterial vector containing the 12-LO cDNA of SEQ ID No. 652 using oligonucleotide primers complementary to the 12-LO cDNA or portion thereof and containing restriction endonuclease sequences for Pst I incorporated into the 5'primer and BglII at the 5' end of the corresponding cDNA 3' primer, taking care to ensure that the sequence encoding the 12-LO protein or a portion thereof is positioned properly with respect to the poly A signal. The purified fragment obtained from the resulting PCR reaction is digested with PstI, blunt ended with an exonuclease, digested with Bgl II, purified and ligated to pXT1, now containing a poly A signal and digested with BglII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 ug/ml G418 (Sigma, St. Louis, Mo.).

Alternatively, the nucleic acids encoding the 12-LO protein or a portion thereof is cloned into pED6dpc2 (Genetics Institute, Cambridge, Mass.). The resulting pED6dpc2 constructs is transfected into a suitable host cell, such as COS 1 cells. Methotrexate resistant cells are selected and expanded.

The above procedures may also be used to express a mutant 12-LO protein responsible for a detectable phenotype or a portion thereof.

The expressed proteins are purified using conventional purification techniques such as ammonium sulfate precipitation or chromatographic separation based on size or charge. The protein encoded by the nucleic acid insert may also be purified using standard immunochromatography techniques. In such procedures, a solution containing the expressed 12-LO protein or portion thereof, such as a cell extract, is applied to a column having antibodies against the 12-LO protein or portion thereof is attached to the chromatography matrix. The expressed protein is allowed to bind the immunochromatography column. Thereafter, the column is washed to remove non-specifically bound proteins. The specifically bound expressed protein is then released from the column and recovered using standard techniques.

To confirm expression of the 12-LO protein or a portion thereof, the proteins expressed from host cells containing an expression vector containing an insert encoding the 12-LO protein or a portion thereof can be compared to the proteins expressed in host cells containing the expression vector without an insert. The presence of a band in samples from cells containing the expression vector with an insert which is absent in samples from cells containing the expression vector without an insert indicates that the 12-LO protein or a portion thereof is being expressed. Generally, the band will have the mobility expected for the 12-LO protein or portion thereof. However, the band may have a mobility different than that expected as a result of modifications such as glycosylation, ubiquitination, or enzymatic cleavage.

Antibodies capable of specifically recognizing the expressed 12-LO protein or a portion thereof, are described below.

If antibody production is not possible, the nucleic acids encoding the 12-LO protein or a portion thereof is incorporated into expression vectors designed for use in purification schemes employing chimeric polypeptides. In such strategies the nucleic acid encoding the 12-LO protein or a portion thereof is inserted in frame with the gene encoding the other half of the chimera. The other half of the chimera is β-globin or a nickel binding polypeptide encoding sequence. A chromatography matrix having antibody to β-globin or nickel attached thereto is then used to purify the chimeric protein. Protease cleavage sites is engineered between the β-globin gene or the nickel binding polypeptide and the 12-LO protein or portion thereof. Thus, the two polypeptides of the chimera are separated from one another by protease digestion.

One useful expression vector for generating β-globin chimerics is pSG5 (Stratagene), which encodes rabbit β-globin. Intron II of the rabbit β-globin gene facilitates splicing of the expressed transcript, and the polyadenylation signal incorporated into the construct increases the level of expression. These techniques are well known to those skilled in the art of molecular biology. Standard methods are published in methods texts such as Davis et al., (*Basic Methods in Molecular Biology*, L. G. Davis, M. D. Dibner, and J. F. Battey, ed., Elsevier Press, NY, 1986, the disclosure of which is incorporated herein by reference in its entirety) and many of the methods are available from Stratagene, Life Technologies, Inc., or Promega. Polypeptide may additionally be produced from the construct using in vitro translation systems such as the In vitro Express™ Translation Kit (Stratagene).

F. Production of Antibodies against 12-Lipoxygenase Polypeptides

Any 12-LO polypeptide or whole protein may be used to generate antibodies capable of specifically binding to expressed 12-LO protein or fragments thereof as described. The antibody compositions of the invention are capable of specifically binding to the 189-His variant of the 12-LO protein or, to the 225-His variant of the 12-LO protein or, to the 243-Cys variant of the 12-LO protein or, to the 261-Arg variant of the 12-LO protein or, to the 322-Asn variant of the 12-LO or, to the 337-Arg variant of the 12-LO protein or to the 574-Lys variant of the 12-LO protein. A preferred embodiment of the invention encompasses isolated or purified antibody compositions capable of selectively binding, or which are capable of binding to an epitope-containing fragment of a polypeptide of the invention, wherein said epitope comprises at least one amino acid position selected from the group consisting of an His residue et amino acid position 189, an His residue at amino acid position 225, a Cys residue at amino acid position 243, an Arg residue at amino acid position 261, an Asn residue at amino acid position 322, an Arg residue at amino acid position 337, a Asn residue at amino acid position 362, an Asn at amino acid position 568 and a Lys residue at amino acid position 574. For an antibody composition to specifically bind to these 12-LO variants it must demonstrate at least a 5%, 10%, 15%, 20%, 25%, 50%, or 100% greater binding affinity for full length 189-His, 225-His, 243-Cys, 261-Arg, 322-Asn, 337-Arg or 574-Lys variants in an ELISA, RIA, or other antibody-based binding assay than to full length 12-LO proteins which have the alternative amino acid specified in SEQ ID No. 653. Affinity of the antibody composition for the epitope can further be determined by preparing competitive binding curves, as described, for example, by Fisher, D., (Manual of Clinical Immunology, 2nd Ed. (Rose and Friedman,Eds.) *Amer. Soc. For Microbiol.*, Washington, D.C., Ch. 42, 1980), the disclosure of which is incorporated herein by reference in its entirety.

Other preferred antibody compositions of the invention are capable of specifically binding to amino acid positions 110–131 of SEQ ID No. 654.

The present invention also contemplates the use of polypeptides comprising a contiguous span of at least 6 amino acids, preferably at least 8 to 10 amino acids, more preferably at least 12, 15, 20, 25, 50, or 100 amino acids of a 12-LO polypeptide of SEQ ID No. 653 in the manufacture of antibodies, wherein said contiguous span comprises at least one amino acid position selected from the group consisting of: an His residue et amino acid position 189, an His residue at amino acid position 225, a Cys residue at amino acid position 243, an Arg residue at amino acid position 261, an Asn residue at amino acid position 322, an Arg residue at amino acid position 337, a Asn residue at amino acid position 362, an Asn at amino acid position 568 and a Lys residue at amino acid position 574.

In a preferred embodiment such polypeptides are useful in the manufacture of antibodies to detect the presence and absence of the 189-His, 225-His, 243-Cys, 261-Arg, 322-Asn, 337-Arg, 568-Asn, or 574-Lys variant.

The present invention further encompasses the use of isolated, purified, and recombinant polypeptides comprising a contiguous span of at least 6 amino acids, preferably at least 8 to 10 amino acids, more preferably at least 12, 15, 20, 25, 30, 40, 50, or 100 amino acids of SEQ ID No. 654, wherein said contiguous span comprises at least one of amino acid positions 110–131 of SEQ 25 ID No. 654.

In a preferred embodiment such polypeptides are useful in the manufacture of antibodies to detect the presence and absence of amino acid positions 110–131 of SEQ ID No. 654.

Non-human animals or mammals, whether wild-type or transgenic, which express a different species of 12-LO than the one to which antibody binding is desired, and animals which do not express 12-LO (i.e. an 12-LO knock out animal as described in herein) are particularly useful for preparing antibodies. 12-LO knock out animals will recognize all or most of the exposed regions of 12-LO as foreign antigens, and therefore produce antibodies with a wider array of 12-LO epitopes. Moreover, smaller polypeptides with only 10 to 30 amino acids may be useful in obtaining specific binding to the 189-His, 225-His, 243-Cys, 261-Arg, 322-Asn, 337-Arg, 568-Asn, or 574-Lys variants. In addition, the humoral immune system of animals which produce a species of 12-LO that resembles the antigenic sequence will preferentially recognize the differences between the animal's native 12-LO species and the antigen sequence, and produce antibodies to these unique sites in the antigen sequence. Such a technique will be particularly useful in obtaining antibodies that specifically bind to the 189-His, 225-His, 243-Cys, 261-Arg, 322-Asn, 337-Arg, 568-Asn, or 574-Lys variants. The preparation of antibody compositions is further described in Example 6.

Antibody preparations prepared according to the present invention are useful in quantitative immunoassays which determine concentrations of antigen-bearing substances in biological samples; they are also used semi-quantitatively or qualitatively to identify the presence of antigen in a biological sample. The antibodies may also be used in therapeutic compositions for killing cells expressing the protein or reducing the levels of the protein in the body. The antibodies of the invention may be labeled, either by a radioactive, a fluorescent or an enzymatic label. Consequently, the invention is also directed to a method for detecting specifically the presence of a variant 12-LO polypeptide according to the invention in a biological sample, said method comprising the following steps: a) bringing into contact the biological sample with a polyclonal or monoclonal antibody that specifically binds a variant 12-LO polypeptide or to a peptide fragment or variant thereof, and b) detecting the antigen-antibody complex formed. The invention also concerns a diagnostic kit for detecting in vitro the presence of a variant 12-LO polypeptide according to the present invention in a biological sample, wherein said kit comprises:

a) a polyclonal or monoclonal antibody that specifically binds a variant 12-LO polypeptide or to a peptide fragment or variant thereof, optionally labeled;

b) a reagent allowing the detection of the antigen-antibody complexes formed, said reagent carrying optionally a label, or being able to be recognized itself by a labeled reagent, more particularly in the case when the above-mentioned monoclonal or polyclonal antibody is not labeled by itself.

II. Methods for De Novo Identification of Biallelic Markers

Large fragments of human DNA, carrying genes of interest involved in arachidonic acid metabolism; were cloned, sequenced and screened for biallelic markers. Biallelic markers within the candidate genes themselves as well as markers located on the same genomic fragment were identified. It will be clear to one of skill in the art that large fragments of human genomic DNA may be obtained from any appropriate source and may be cloned into a number of suitable vectors.

In a preferred embodiment of the invention, BAC (Bacterial Artificial Chromosomes) vectors were used to construct DNA libraries covering the entire human genome. Specific amplification primers were designed for each candidate gene and the BAC library was screened by PCR until there was at least one positive BAC clone per candidate gene. Genomic sequence, screened for biallelic markers, was generated by sequencing ends of BAC subclones. Details of a preferred embodiment are provided in Example 1. As a preferred alternative to sequencing the ends of an adequate number of BAC subclones, high throughput deletion-based sequencing vectors, which allow the generation of a high quality sequence information covering fragments of about 6 kb, may be used. Having sequence fragments longer than 2.5 or 3 kb enhances the chances of identifying biallelic markers therein. Methods of constructing and sequencing a nested set of deletions are disclosed in the related U.S. patent application entitled "High Throughput DNA Sequencing Vector" (Ser. No. 09/058,746).

In another embodiment of the invention, genomic sequences of candidate genes were available in public databases allowing direct screening for biallelic markers. Any of a variety of methods can be used to screen a genomic fragment for single nucleotide polymorphisms such as differential hybridization with oligonucleotide probes, detection of changes in the mobility measured by gel electrophoresis or direct sequencing of the amplified nucleic acid. A preferred method for identifying biallelic markers involves comparative sequencing of genomic DNA fragments from an appropriate number of unrelated individuals.

In a first embodiment, DNA samples from unrelated individuals are pooled together, following which the genomic DNA of interest is amplified and sequenced. The nucleotide sequences thus obtained are then analyzed to identify significant polymorphisms. One of the major advantages of this method resides in the fact that the pooling of the DNA samples substantially reduces the number of DNA amplification reactions and sequencing reactions, which must be carried out. Moreover, this method is sufficiently sensitive so that a biallelic marker obtained thereby usually demonstrates a sufficient frequency of its less common allele to be useful in conducting association studies. Usually, the frequency of the least common allele of a biallelic marker identified by this method is at least 10%.

In a second embodiment, the DNA samples are not pooled and are therefore amplified and sequenced individually. This method is usually preferred when biallelic markers need to be identified in order to perform association studies within candidate genes. Preferably, highly relevant gene regions such as promoter regions or exon regions may be screened for biallelic markers. A biallelic marker obtained using this method may show a lower degree of informativeness for conducting association studies, e.g. if the frequency of its less frequent allele may be less than about 10%. Such a biallelic marker will however be sufficiently informative to conduct association studies and it will further be appreciated that including less informative biallelic markers in the genetic analysis studies of the present invention, may allow in some cases the direct identification of causal mutations, which may, depending on their penetrance, be rare mutations.

The following is a description of the various parameters of a preferred method used by the inventors for the identification of the biallelic markers of the present invention.

A. Genomic DNA Samples

The genomic DNA samples from which the biallelic markers of the present invention are generated are preferably obtained from unrelated individuals corresponding to a heterogeneous population of known ethnic background. The number of individuals from whom DNA samples are obtained can vary substantially, preferably from about 10 to about 1000, more preferably from about 50 to about 200 individuals. Usually, DNA samples are collected from at least about 100 individuals in order to have sufficient polymorphic diversity in a given population to identify as many markers as possible and to generate statistically significant results.

As for the source of the genomic DNA to be subjected to analysis, any test sample can be foreseen without any particular limitation. These test samples include biological samples, which can be tested by the methods of the present invention described herein, and include human and animal body fluids such as whole blood, serum, plasma, cerebrospinal fluid, urine, lymph fluids, and various external secretions of the respiratory, intestinal and genitourinary tracts, tears, saliva, milk, white blood cells, myelomas and the like; biological fluids such as cell culture supernatants; fixed tissue specimens including tumor and non-tumor tissue and lymph node tissues; bone marrow aspirates and fixed cell specimens. The preferred source of genomic DNA used in the present invention is from peripheral venous blood of each donor. Techniques to prepare genomic DNA from biological samples are well known to the skilled technician. Details of a preferred embodiment are provided in Example 1. A person skilled in the art can choose to amplify pooled or unpooled DNA samples.

B. DNA Amplification

The identification of biallelic markers in a sample of genomic DNA may be facilitated through the use of DNA amplification methods. DNA samples can be pooled or unpooled for the amplification step. DNA amplification techniques are well known to those skilled in the art. Various methods to amplify DNA fragments carrying biallelic markers are further described hereinafter in III.B. The PCR technology is the preferred amplification technique used to identify new biallelic markers.

In a first embodiment, biallelic markers are identified using genomic sequence information generated by the inventors. Genomic DNA fragments, such as the inserts of the BAC clones described above, are sequenced and used to design primers for the amplification of 500 bp fragments. These 500 bp fragments are amplified from genomic DNA and are scanned for biallelic markers. Primers may be designed using the OSP software (Hillier L. and Green P., *Methods Appl.* 1: 124–8, 1991). All primers may contain, upstream of the specific target bases, a common oligonucleotide tail that serves as a sequencing primer. Those skilled in the art are familiar with primer extensions, which can be used for these purposes.

In another embodiment of the invention, genomic sequences of candidate genes are available in public databases allowing direct screening for biallelic markers. Preferred primers, useful for the amplification of genomic sequences encoding the candidate genes, focus on promoters, exons and splice sites of the genes. A biallelic marker present in these functional regions of the gene has a higher probability to be a causal mutation.

Preferred primers include those disclosed in Table 13.

C. Sequencing of Amplified Genomic DNA and Identification of Single Nucleotide Polymorphisms The amplification products generated as described above, are then sequenced using any method known and available to the skilled technician. Methods for sequencing DNA using either the dideoxy-mediated method (Sanger method) or the Maxam-Gilbert method are widely known to those of ordinary skill in the art. Such methods are for example disclosed in Maniatis et al. (Molecular Cloning, A Laboratory Manual, Cold Spring Harbor Press, 2nd Edition, 1989). Alternative approaches include hybridization to high-density DNA probe arrays as described in Chee et al. (*Science* 274:610, 1996).

Preferably, the amplified DNA is subjected to automated dideoxy terminator sequencing reactions using a dye-primer cycle sequencing protocol. The products of the sequencing reactions are run on sequencing gels and the sequences are determined using gel image analysis. The polymorphism search is based on the presence of superimposed peaks in the electrophoresis pattern resulting from different bases occurring at the same position. Because each dideoxy terminator is labeled with a different fluorescent molecule, the two peaks corresponding to a biallelic site present distinct colors corresponding to two different nucleotides at the same position on the sequence. However, the presence of two peaks can be an artifact due to background noise. To exclude such an artifact, the two DNA strands are sequenced and a comparison between the peaks is carried out. In order to be registered as a polymorphic sequence, the polymorphism has to be detected on both strands.

The above procedure permits those amplification products, which contain biallelic markers to be identified. The detection limit for the frequency of biallelic polymorphisms detected by sequencing pools of 100 individuals is approximately 0.1 for the minor allele, as verified by sequencing pools of known allelic frequencies. However, more than 90% of the biallelic polymorphisms detected by the pooling method have a frequency for the minor allele higher than 0.25. Therefore, the biallelic markers selected by this method have a frequency of at least 0.1 for the minor allele and less than 0.9 for the major allele. Preferably at least 0.2 for the minor allele and less than 0.8 for the major allele, more preferably at least 0.3 for the minor allele and less than 0.7 for the major allele, thus a heterozygosity rate higher than 0.18, preferably higher than 0.32, more preferably higher than 0.42.

In another embodiment, biallelic markers are detected by sequencing individual DNA samples, the frequency of the minor allele of such a biallelic marker may be less than 0.1.

The markers carried by the same fragment of genomic DNA, such as the insert in a BAC clone, need not necessarily be ordered with respect to one another within the genomic fragment to conduct association studies. However, in some embodiments of the present invention, the order of biallelic markers carried by the same fragment of genomic DNA are determined.

D. Validation of the Biallelic Markers of the Present Invention

The polymorphisms are evaluated for their usefulness as genetic markers by validating that both alleles are present in a population. Validation of the biallelic markers is accomplished by genotyping a group of individuals by a method of the invention and demonstrating that both alleles are present. Microsequencing is a preferred method of genotyping alleles. The validation by genotyping step may be performed on individual samples derived from each individual in the group or by genotyping a pooled sample derived from more than one individual. The group can be as small as one individual if that individual is heterozygous for the allele in question. Preferably the group contains at least three individuals, more preferably the group contains five or six individuals, so that a single validation test will be more likely to result in the validation of more of the biallelic markers that are being tested. It should be noted, however, that when the validation test is performed on a small group it may result in a false negative result if as a result of sampling error none of the individuals tested carries one of the two alleles. Thus, the validation process is less useful in demonstrating that a particular initial result is an artifact, than it is at demonstrating that there is a bona fide biallelic marker at a particular position in a sequence. For an indication of whether a particular biallelic marker has been validated see Table 7(A–B). All of the genotyping, haplotyping, association, and interaction study methods of the invention may optionally be performed solely with validated biallelic markers.

E. Evaluation of the Frequency of the Biallelic Markers of the Present Invention The validated biallelic markers are further evaluated for their usefulness as genetic markers by determining the frequency of the least common allele at the biallelic marker site. The determination of the least common allele is accomplished by genotyping a group of individuals by a method of the invention and demonstrating that both alleles are present. This determination of frequency by genotyping step may be performed on individual samples derived from each individual in the group or by genotyping a pooled sample derived from more than one individual. The group must be large enough to be representative of the population as a whole. Preferably the group contains at least 20 individuals, more preferably the group contains at least 50 individuals, most preferably the group contains at least 100 individuals. Of course the larger the group the greater the accuracy of the frequency determination because of reduced sampling error. For an indication of the frequency for the less common allele of a particular biallelic marker of the invention see Table 7(A–B). A biallelic marker wherein the frequency of the less common allele is 30% or more is termed a "high quality biallelic marker." All of the genotyping, haplotyping, association, and interaction study methods of the invention may optionally be performed solely with high quality biallelic markers.

III. Methods of Genotyping an Individual for Biallelic Markers

Methods are provided to genotype a biological sample for one or more biallelic markers of the present invention, all of which may be performed in vitro. Such methods of genotyping comprise determining the identity of a nucleotide at an eicosanoid-related biallelic marker by any method known in the art. These methods find use in genotyping case-control populations in association studies as well as individuals in the context of detection of alleles of biallelic markers which, are known to be associated with a given trait, in which case both copies of the biallelic marker present in individual's genome are determined so that an individual may be classified as homozygous or heterozygous for a particular allele.

These genotyping methods can be performed nucleic acid samples derived from a single individual or pooled DNA samples.

Genotyping can be performed using similar methods as those described above for the identification of the biallelic markers, or using other genotyping methods such as those further described below. In preferred embodiments, the comparison of sequences of amplified genomic fragments from different individuals is used to identify new biallelic markers whereas microsequencing is used for genotyping known biallelic markers in diagnostic and association study applications.

A. Source of DNA for Genotyping

Any source of nucleic acids, in purified or non-purified form, can be utilized as the starting nucleic acid, provided it contains or is suspected of containing the specific nucleic acid sequence desired. DNA or RNA may be extracted from cells, tissues, body fluids and the like as described above in II.A. While nucleic acids for use in the genotyping methods of the invention can be derived from any mammalian source, the test subjects and individuals from which nucleic acid samples are taken are generally understood to be human.

B. Amplification of DNA Fragments Comprising Biallelic Markers

Methods and polynucleotides are provided to amplify a segment of nucleotides comprising one or more biallelic marker of the present invention. It will be appreciated that amplification of DNA fragments comprising biallelic markers may be used in various methods and for various purposes and is not restricted to genotyping. Nevertheless, many genotyping methods, although not all, require the previous amplification of the DNA region carrying the biallelic marker of interest. Such methods specifically increase the concentration or total number of sequences that span the biallelic marker or include that site and sequences located either distal or proximal to it. Diagnostic assays may also rely on amplification of DNA segments carrying a biallelic marker of the present invention.

Amplification of DNA may be achieved by any method known in the art. The established PCR (polymerase chain reaction) method or by developments thereof or alternatives. Amplification methods which can be utilized herein include but are not limited to Ligase Chain Reaction (LCR) as described in EP A 320 308 and EP A 439 182, Gap LCR (Wolcott, M. J., Clin. Mcrobiol. Rev. 5:370–386), the so-called "NASBA" or "3SR" technique described in Guatelli J. C. et al. (*Proc. Natl. Acad. Sci. USA* 87:1874–1878, 1990) and in Compton J. (*Nature* 350:91–92, 1991), Q-beta amplification as described in European Patent Application no 4544610, strand displacement amplification as described in Walker et al. (*Clin. Chem.* 42:9–13, 1996) and EP A 684 315 and, target mediated amplification as described in PCT Publication WO 9322461.

LCR and Gap LCR are exponential amplification techniques, both depend on DNA ligase to join adjacent primers annealed to a DNA molecule. In Ligase Chain Reaction (LCR), probe pairs are used which include two primary (first and second) and two secondary (third and fourth) probes, all of which are employed in molar excess to target. The first probe hybridizes to a first segment of the target strand and the second probe hybridizes to a second segment of the target strand, the first and second segments being contiguous so that the primary probes abut one another in 5' phosphate-3'hydroxyl relationship, and so that a ligase can covalently fuse or ligate the two probes into a fused product. In addition, a third (secondary) probe can hybridize to a portion of the first probe and a fourth (secondary) probe can hybridize to a portion of the second probe in a similar abutting fashion. Of course, if the target is initially double stranded, the secondary probes also will hybridize to the target complement in the first instance. Once the ligated strand of primary probes is separated from the target strand, it will hybridize with the third and fourth probes which can be ligated to form a complementary, secondary ligated product. It is important to realize that the ligated products are functionally equivalent to either the target or its complement. By repeated cycles of hybridization and ligation, amplification of the target sequence is achieved. A method for multiplex LCR has also been described (WO 9320227). Gap LCR (GLCR) is a version of LCR where the probes are not adjacent but are separated by 2 to 3 bases.

For amplification of mRNAs, it is within the scope of the present invention to reverse transcribe mRNA into cDNA followed by polymerase chain reaction (RT-PCR); or, to use a single enzyme for both steps as described in U.S. Pat. No. 5,322,770 or, to use Asymmetric Gap LCR (RT-AGLCR) as described by Marshall R. L. et al. (*PCR Methods and Applications* 4:80–84, 1994). AGLCR is a modification of GLCR that allows the amplification of RNA.

Some of these amplification methods are particularly suited for the detection of single nucleotide polymorphisms and allow the simultaneous amplification of a target sequence and the identification of the polymorphic nucleotide as it is further described in IIIC.

The PCR technology is the preferred amplification technique used in the present invention. A variety of PCR techniques are familiar to those skilled in the art. For a review of PCR technology, see Molecular Cloning to Genetic Engineering White, B. A. Ed. in *Methods in Molecular Biology* 67: Humana Press, Totowa (1997) and the publication entitled "PCR Methods and Applications" (1991, Cold Spring Harbor Laboratory Press). In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites. PCR has further been described in several patents including U.S. Pat. Nos. 4,683,195, 4,683,202 and 4,965,188.

The identification of biallelic markers as described above allows the design of appropriate oligonucleotides, which can be used as primers to amplify DNA fragments comprising the biallelic markers of the present invention. Amplification can be performed using the primers initially used to discover new biallelic markers which are described herein or any set of primers allowing the amplification of a DNA fragment comprising a biallelic marker of the present invention. Primers can be prepared by any suitable method. As for example, direct chemical synthesis by a method such as the phosphodiester method of Narang S. A. et al. (*Methods Enzymol.* 68:90–98, 1979), the phosphodiester method of Brown E. L. et al. (*Methods Enzymol.* 68:109–151, 1979), the diethylphosphoramidite method of Beaucage et al. (*Tetrahedron Lett.* 22:1859–1862, 1981) and the solid support method described in EP 0 707 592.

In some embodiments the present invention provides primers for amplifying a DNA fragment containing one or more biallelic markers of the present invention. Preferred amplification primers are listed in Table 13. It will be appreciated that the primers listed are merely exemplary and that any other set of primers which produce amplification products containing one or more biallelic markers of the present invention.

The primers are selected to be substantially complementary to the different strands of each specific sequence to be amplified. The length of the primers of the present invention can range from 8 to 100 nucleotides, preferably from 8 to 50, 8 to 30 or more preferably 8 to 25 nucleotides. Shorter primers tend to lack specificity for a target nucleic acid sequence and generally require cooler temperatures to form sufficiently stable hybrid complexes with the template. Longer primers are expensive to produce and can sometimes self-hybridize to form hairpin structures. The formation of stable hybrids depends on the melting temperature (Tm) of the DNA. The Tm depends on the length of the primer, the ionic strength of the solution and the G+C content. The higher the G+C content of the primer, the higher is the melting temperature because G:C pairs are held by three H bonds whereas A:T pairs have only two. The G+C content of the amplification primers of the present invention preferably ranges between 10 and 75%, more preferably between 35 and 60%, and most preferably between 40 and 55%. The appropriate length for primers under a particular set of assay conditions may be empirically determined by one of skill in the art.

The spacing of the primers determines the length of the segment to be amplified. In the context of the present invention amplified segments carrying biallelic markers can range in size from at least about 25 bp to 35 kbp. Amplification fragments from 25–3000 bp are typical, fragments from 50–1000 bp are preferred and fragments from 100–600 bp are highly preferred. It will be appreciated that amplification primers for the biallelic markers may be any sequence which allow the specific amplification of any DNA fragment carrying the markers. Amplification primers may be labeled or immobilized on a solid support as described in I "Biallelic Markers and Polynucleotides Comprising Biallelic Markers."

C. Methods of Genotyping DNA Samples for Biallelic Markers

Any method known in the art can be used to identify the nucleotide present at a biallelic marker site. Since the biallelic marker allele to be detected has been identified and specified in the present invention, detection will prove simple for one of ordinary skill in the art by employing any of a number of techniques. Many genotyping methods require the previous amplification of the DNA region carrying the biallelic marker of interest. While the amplification of target or signal is often preferred at present, ultrasensitive detection methods which do not require amplification are also encompassed by the present genotyping methods. Methods well-known to those skilled in the art that can be used to detect biallelic polymorphisms include methods such as, conventional dot blot analyzes, single strand conformational polymorphism analysis (SSCP) described by Orita et al. (*Proc. Natl. Acad. Sci. U.S.A* 86:27776–2770, 1989), denaturing gradient gel electrophoresis (DGGE), heteroduplex analysis, mismatch cleavage detection, and other conventional techniques as described in Sheffield, V. C. et al. (*Proc. Natl. Acad. Sci. USA* 49:699–706, 1991), White et al. (*Genomics* 12:301–306, 1992), Grompe, M. et al. (*Proc. Natl. Acad. Sci. USA* 86:5855–5892, 1989) and Grompe, M. (*Nature Genetics* 5:111–117, 1993). Another method for determining the identity of the nucleotide present at a particular polymorphic site employs a specialized exonuclease-resistant nucleotide derivative as described in U.S. Pat. No. 4,656,127.

Preferred methods involve directly determining the identity of the nucleotide present at a biallelic marker site by sequencing assay, enzyme-based mismatch detection assay, or hybridization assay. The following is a description of some preferred methods. A highly preferred method is the microsequencing technique. The term "sequencing assay" is used herein to refer to polymerase extension of duplex primer/template complexes and includes both traditional sequencing and microsequencing.

1. Sequencing Assays.

The nucleotide present at a polymorphic site can be determined by sequencing methods. In a preferred embodiment, DNA samples are subjected to PCR amplification before sequencing as described above. DNA sequencing methods are described in IIC.

Preferably, the amplified DNA is subjected to automated dideoxy terminator sequencing reactions using a dye-primer cycle sequencing protocol. Sequence analysis allows the identification of the base present at the biallelic marker site.

2. Microsequencing Assays

In microsequencing methods, a nucleotide at the polymorphic site that is unique to one of the alleles in a target DNA is detected by a single nucleotide primer extension reaction. This method involves appropriate microsequencing primers which, hybridize just upstream of a polymorphic base of interest in the target nucleic acid. A polymerase is used to specifically extend the 3' end of the primer with one single ddNTP (chain terminator) complementary to the selected nucleotide at the polymorphic site. Next the identity of the incorporated nucleotide is determined in any suitable way.

Typically, microsequencing reactions are carried out using fluorescent ddNTPs and the extended microsequencing primers are analyzed by electrophoresis on ABI 377 sequencing machines to determine the identity of the incorporated nucleotide as described in EP 412 883. Alternatively capillary electrophoresis can be used in order to process a higher number of assays simultaneously. An example of a typical microsequencing procedure that can be used in the context of the present invention is provided in Example 2.

Different approaches can be used to detect the nucleotide added to the microsequencing primer. A homogeneous phase detection method based on fluorescence resonance energy transfer has been described by Chen and Kwok (*Nucleic Acids Research* 25:347–353 1997) and Chen et al. (*Proc. Natl. Acad. Sci. USA* 94/20 10756–10761,1997). In this method amplified genomic DNA fragments containing polymorphic sites are incubated with a 5'-fluorescein-labeled primer in the presence of allelic dye-labeled dideoxyribonucleoside triphosphates and a modified Taq polymerase. The dye-labeled primer is extended one base by the dye-terminator specific for the allele present on the template. At the end of the genotyping reaction, the fluorescence intensities of the two dyes in the reaction mixture are analyzed directly without separation or purification. All these steps can be performed in the same tube and the fluorescence changes can be monitored in real time. Alternatively, the extended primer may be analyzed by MALDI-TOF Mass Spectrometry. The base at the polymorphic site is identified by the mass added onto the microsequencing primer (see Haff L. A. and Smirnov I. P., *Genome Research*, 7:378–388, 1997).

Microsequencing may be achieved by the established microsequencing method or by developments or derivatives thereof. Alternative methods include several solid-phase microsequencing techniques. The basic microsequencing protocol is the same as described previously, except that the method is conducted as a heterogenous phase assay, in which the primer or the target molecule is immobilized or captured onto a solid support. To simplify the primer separation and the terminal nucleotide addition analysis, oligonucleotides are attached to solid supports or are modified in such ways that permit affinity separation as well as polymerase extension. The 5' ends and internal nucleotides of synthetic oligonucleotides can be modified in a number of different ways to permit different affinity separation approaches, e.g., biotinylation. If a single affinity group is used on the oligonucleotides, the oligonucleotides can be separated from the incorporated terminator reagent. This eliminates the need of physical or size separation. More than one oligonucleotide can be separated from the terminator reagent and analyzed simultaneously if more than one affinity group is used. This permits the analysis of several nucleic acid species or more nucleic acid sequence information per extension reaction. The affinity group need not be on the priming oligonucleotide but could alternatively be present on the template. For example, immobilization can be carried out via an interaction between biotinylated DNA and streptavidin-coated microtitration wells or avidin-coated polystyrene particles. In the same manner oligonucleotides or templates may be attached to a solid support in a high-density format. In such solid phase microsequencing reactions, incorporated ddNTPs can be radiolabeled (Syvänen, *Clinica Chimica Acta* 226:225–236, 1994) or linked to fluorescein (Livak and Hainer, *Human Mutation* 3:379–385, 1994). The detection of radiolabeled ddNTPs can be achieved through scintillation-based techniques. The detection of fluorescein-linked ddNTPs can be based on the binding of antifluorescein antibody conjugated with alkaline phosphatase, followed by incubation with a chromogenic substrate (such as p-nitrophenyl phosphate). Other possible reporter-detection pairs include: ddNTP linked to dinitrophenyl (DNP) and anti-DNP alkaline phosphatase conjugate (Harju et al., *Clin. Chem.* 39/11 2282–2287, 1993) or biotinylated ddNTP and horseradish peroxidase-conjugated streptavidin with o-phenylenediamine as a substrate (WO 92/15712). As yet another alternative solid-phase microsequencing procedure, Nyren et al. (*Analytical Biochemistry* 208:171–175, 1993) described a method relying on the detection of DNA polymerase activity by an enzymatic luminometric inorganic pyrophosphate detection assay (ELIDA).

Pastinen et al. (*Genome research* 7:606–614, 1997) describe a method for multiplex detection of single nucleotide polymorphism in which the solid phase minisequencing principle is applied to an oligonucleotide array format. High-density arrays of DNA probes attached to a solid support (DNA chips) are further described in III.C.5.

In one aspect the present invention provides polynucleotides and methods to genotype one or more biallelic markers of the present invention by performing a microsequencing assay. Preferred microsequencing primers include those being featured Table 12. It will be appreciated that the microsequencing primers listed in Table 12 are merely exemplary and that, any primer having a 3' end immediately adjacent to a polymorphic nucleotide may be used. Similarly, it will be appreciated that microsequencing analysis may be performed for any biallelic marker or any combination of biallelic markers of the present invention. One aspect of the present invention is a solid support which includes one or more microsequencing primers listed in Table 12, or fragments comprising at least 8, at least 12, at least 15, or at least 20 consecutive nucleotides thereof and having a 3' terminus immediately upstream of the corresponding biallelic marker, for determining the identity of a nucleotide at biallelic marker site.

3. Mismatch Detection Assays Based on Polymerases and Ligases

In one aspect the present invention provides polynucleotides and methods to determine the allele of one or more biallelic markers of the present invention in a biological sample, by mismatch detection assays based on polymerases and/or ligases. These assays are based on the specificity of polymerases and ligases. Polymerization reactions places particularly stringent requirements on correct base pairing of the 3' end of the amplification primer and the joining of two oligonucleotides hybridized to a target DNA sequence is quite sensitive to mismatches close to the ligation site, especially at the 3' end. The terms "enzyme based mismatch detection assay" are used herein to refer to any method of determining the allele of a biallelic marker based on the specificity of ligases and polymerases. Preferred methods are described below. Methods, primers and various parameters to amplify DNA fragments comprising biallelic markers of the present invention are further described above in III.B.

Allele Specific Amplification

Discrimination between the two alleles of a biallelic marker can also be achieved by allele specific amplification, a selective strategy, whereby one of the alleles is amplified without amplification of the other allele. This is accomplished by placing a polymorphic base at the 3' end of one of the amplification primers. Because the extension forms from the 3'end of the primer, a mismatch at or near this position has an inhibitory effect on amplification. Therefore, under appropriate amplification conditions, these primers only direct amplification on their complementary allele. Designing the appropriate allele-specific primer and the corresponding assay conditions are well with the ordinary skill in the art.

Ligation/Amplification Based Methods

The "Oligonucleotide Ligation Assay" (OLA) uses two oligonucleotides which are designed to be capable of hybridizing to abutting sequences of a single strand of a target molecules. One of the oligonucleotides is biotinylated, and the other is detectably labeled. If the precise complementary sequence is found in a target molecule, the oligonucleotides will hybridize such that their termini abut, and create a ligation substrate that can be captured and detected. OLA is capable of detecting biallelic markers and may be advantageously combined with PCR as described by Nickerson D. A. et al. (*Proc. Natl. Acad. Sci. U.S.A.* 87:8923–8927, 1990). In this method, PCR is used to achieve the exponential amplification of target DNA, which is then detected using OLA.

Other methods which are particularly suited for the detection of biallelic markers include LCR (ligase chain reaction), Gap LCR (GLCR) which are described above in III.B. As mentioned above LCR uses two pairs of probes to exponentially amplify a specific target. The sequences of each pair of oligonucleotides, is selected to permit the pair to hybridize to abutting sequences of the same strand of the target. Such hybridization forms a substrate for a template-dependant ligase. In accordance with the present invention, LCR can be performed with oligonucleotides having the proximal and distal sequences of the same strand of a biallelic marker site. In one embodiment, either oligonucleotide will be designed to include the biallelic marker site. In such an embodiment, the reaction conditions are selected such that the oligonucleotides can be ligated together only if the target molecule either contains or lacks the specific nucleotide(s) that is complementary to the biallelic marker on the oligonucleotide. In an alternative embodiment, the oligonucleotides will not include the biallelic marker, such that when they hybridize to the target molecule, a "gap" is created as described in WO 90/01069. This gap is then "filled" with complementary dNTPs (as mediated by DNA polymerase), or by an additional pair of oligonucleotides. Thus at the end of each cycle, each single strand has a complement capable of serving as a target during the next cycle and exponential allele-specific amplification of the desired sequence is obtained.

Ligase/Polymerase-mediated Genetic Bit Analysis™ is another method for determining the identity of a nucleotide at a preselected site in a nucleic acid molecule (WO 95/21271). This method involves the incorporation of a nucleoside triphosphate that is complementary to the nucleotide present at the preselected site onto the terminus of a primer molecule, and their subsequent ligation to a second oligonucleotide. The reaction is monitored by detecting a specific label attached to the reaction's solid phase or by detection in solution.

4. Hybridization Assay Methods

A preferred method of determining the identity of the nucleotide present at a biallelic marker site involves nucleic acid hybridization. The hybridization probes, which can be conveniently used in such reactions, preferably include the probes defined herein. Any hybridization assay may be used including Southern hybridization, Northern hybridization, dot blot hybridization and solid-phase hybridization (see Sambrook et al., Molecular Cloning—A Laboratory Manual, Second Edition, Cold Spring Harbor Press, N.Y., 1989).

Hybridization refers to the formation of a duplex structure by two single stranded nucleic acids due to complementary base pairing. Hybridization can occur between exactly complementary nucleic acid strands or between nucleic acid strands that contain minor regions of mismatch. Specific probes can be designed that hybridize to one form of a biallelic marker and not to the other and therefore are able to discriminate between different allelic forms. Allele-specific probes are often used in pairs, one member of a pair showing perfect match to a target sequence containing the original allele and the other showing a perfect match to the target sequence containing the alternative allele. Hybridization conditions should be sufficiently stringent that there is a significant difference in hybridization intensity between alleles, and preferably an essentially binary response, whereby a probe hybridizes to only one of the alleles. Stringent, sequence specific hybridization conditions, under which a probe will hybridize only to the exactly complementary target sequence are well known in the art (Sambrook et al., Molecular Cloning—A Laboratory Manual, Second Edition, Cold Spring Harbor Press, N.Y., 1989). Stringent conditions are sequence dependent and will be different in different circumstances. Generally, stringent conditions are selected to be about 5° C. lower than the thermal melting point (Tm) for the specific sequence at a defined ionic strength and pH. By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in prehybridization mixture containing 100 µg/ml denatured salmon sperm DNA and 5–20×10$^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of high and intermediate stringency which may be used are well known in the art and as cited in Sambrook et al. (Molecular Cloning—A Laboratory Manual, Second Edition, Cold Spring Harbor Press, N.Y., 1989) and Ausubel et al. (Current Protocols in Molecular Biology, Green Publishing Associates and Wiley Interscience, N.Y., 1989).

Although such hybridizations can be performed in solution, it is preferred to employ a solid-phase hybridization assay. The target DNA comprising a biallelic marker of the present invention may be amplified prior to the hybridization reaction. The presence of a specific allele in the sample is determined by detecting the presence or the absence of stable hybrid duplexes formed between the probe and the target DNA. The detection of hybrid duplexes can be carried out by a number of methods. Various detection assay formats are well known which utilize detectable labels bound to either the target or the probe to enable detection of the hybrid duplexes. Typically, hybridization duplexes are separated from unhybridized nucleic acids and the labels bound to the duplexes are then detected. Those skilled in the art will recognize that wash steps may be employed to wash away excess target DNA or probe. Standard heterogeneous assay formats are suitable for detecting the hybrids using the labels present on the primers and probes.

Two recently developed assays allow hybridization-based allele discrimination with no need for separations or washes (see Landegren U. et al., *Genome Research*, 8:769–776, 1998). The TaqMan assay takes advantage of the 5' nuclease activity of Taq DNA polymerase to digest a DNA probe annealed specifically to the accumulating amplification product. TaqMan probes are labeled with a donor-acceptor dye pair that interacts via fluorescence energy transfer. Cleavage of the TaqMan probe by the advancing polymerase during amplification dissociates the donor dye from the quenching acceptor dye, greatly increasing the donor fluorescence. All reagents necessary to detect two allelic variants can be assembled at the beginning of the reaction and the results are monitored in real time (see Livak et al., *Nature Genetics*, 9:341–342, 1995). In an alternative homogeneous hybridization-based procedure, molecular beacons are used for allele discriminations. Molecular beacons are hairpin-shaped oligonucleotide probes that report the presence of specific nucleic acids in homogeneous solutions. When they bind to their targets they undergo a conformational reorganization that restores the fluorescence of an internally quenched fluorophore (Tyagi et al., *Nature Biotechnology*, 16:49–53, 1998).

The polynucleotides provided herein can be used in hybridization assays for the detection of biallelic marker alleles in biological samples. These probes are characterized in that they preferably comprise between 8 and 50 nucleotides, and in that they are sufficiently complementary to a sequence comprising a biallelic marker of the present invention to hybridize thereto and preferably sufficiently specific to be able to discriminate the targeted sequence for only one nucleotide variation. The GC content in the probes of the invention usually ranges between 10 and 75%, preferably between 35 and 60%, and more preferably between 40 and 55%. The length of these probes can range from 10, 15, 20, or 30 to at least 100 nucleotides, preferably from 10 to 50, more preferably from 18 to 35 nucleotides. A particularly preferred probe is 25 nucleotides in length. Preferably the biallelic marker is within 4 nucleotides of the center of the polynucleotide probe. In particularly preferred probes the biallelic marker is at the center of said polynucleotide. Shorter probes may lack specificity for a target nucleic acid sequence and generally require cooler temperatures to form sufficiently stable hybrid complexes with the template. Longer probes are expensive to produce and can sometimes self-hybridize to form hairpin structures. Methods for the synthesis of oligonucleotide probes have been described above and can be applied to the probes of the present invention.

Preferably the probes of the present invention are labeled or immobilized on a solid support. Labels and solid supports are further described in I. Detection probes are generally nucleic acid sequences or uncharged nucleic acid analogs such as, for example peptide nucleic acids which are disclosed in International Patent Application WO 92/20702, morpholino analogs which are described in U.S. Pat. Nos. 5,185,444; 5,034,506 and 5,142,047. The probe may have to be rendered "non-extendable" in that additional dNTPs cannot be added to the probe. In and of themselves analogs usually are non-extendable and nucleic acid probes can be rendered non-extendable by modifying the 3' end of the probe such that the hydroxyl group is no longer capable of participating in elongation. For example, the 3' end of the probe can be functionalized with the capture or detection label to thereby consume or otherwise block the hydroxyl group. Alternatively, the 3' hydroxyl group simply can be cleaved, replaced or modified, U.S. patent application Ser. No. 07/049,061 filed Apr. 19, 1993 describes modifications, which can be used to render a probe non-extendable.

The probes of the present invention are useful for a number of purposes. They can be used in Southern hybridization to genomic DNA or Northern hybridization to mRNA. The probes can also be used to detect PCR amplification products. By assaying the hybridization to an allele specific probe, one can detect the presence or absence of a biallelic marker allele in a given sample.

High-Throughput parallel hybridizations in array format are specifically encompassed within "hybridization assays" and are described below.

Hybridization to Addressable Arrays of Oligonucleotides

Hybridization assays based on oligonucleotide arrays rely on the differences in hybridization stability of short oligonucleotides to perfectly matched and mismatched target sequence variants. Efficient access to polymorphism information is obtained through a basic structure comprising high-density arrays of oligonucleotide probes attached to a solid support (the chip) at selected positions. Each DNA chip can contain thousands to millions of individual synthetic DNA probes arranged in a grid-like pattern and miniaturized to the size of a dime.

The chip technology has already been applied with success in numerous cases. For example, the screening of mutations has been undertaken in the BRCA1 gene, in *S. cerevisiae* mutant strains, and in the protease gene of HIV-1 virus (Hacia et al., *Nature Genetics*, 14(4):441–447, 1996; Shoemaker et al., *Nature Genetics*, 14(4):450–456, 1996; Kozal et al., *Nature Medicine*, 2:753–759, 1996). Chips of various formats for use in detecting biallelic polymorphisms can be produced on a customized basis by Affymetrix (GeneChip™), Hyseq (HyChip and HyGnostics), and Protogene Laboratories.

In general, these methods employ arrays of oligonucleotide probes that are complementary to target nucleic acid sequence segments from an individual which, target sequences include a polymorphic marker. EP785280 describes a tiling strategy for the detection of single nucleotide polymorphisms. Briefly, arrays may generally be "tiled" for a large number of specific polymorphisms. By "tiling" is generally meant the synthesis of a defined set of oligonucleotide probes which is made up of a sequence complementary to the target sequence of interest, as well as preselected variations of that sequence, e.g., substitution of one or more given positions with one or more members of the basis set of monomers, i.e. nucleotides. Tiling strategies are further described in PCT application No. WO 95/11995. In a particular aspect, arrays are tiled for a number of specific, identified biallelic marker sequences. In particular the array is tiled to include a number of detection blocks, each detection block being specific for a specific biallelic marker or a set of biallelic markers. For example, a detection block may be tiled to include a number of probes, which span the sequence segment that includes a specific polymorphism. To ensure probes that are complementary to each allele, the probes are synthesized in pairs differing at the biallelic marker. In addition to the probes differing at the polymorphic base, monosubstituted probes are also generally tiled within the detection block. These monosubstituted probes have bases at and up to a certain number of bases in either direction from the polymorphism, substituted with the remaining nucleotides (selected from A, T, G, C and U). Typically the probes in a tiled detection block will include substitutions of the sequence positions up to and including those that are 5 bases away from the biallelic marker. The monosubstituted probes provide internal controls for the tiled array, to distinguish actual hybridization from artefactual cross-hybridization. Upon completion of hybridization with the target sequence and washing of the array, the array is scanned to determine the position on the array to which the target sequence hybridizes. The hybridization data from the scanned array is then analyzed to identify which allele or alleles of the biallelic marker are present in the sample. Hybridization and scanning may be carried out as described in PCT application No. WO 92/10092 and WO 95/11995 and U.S. Pat. No. 5,424,186.

Thus, in some embodiments, the chips may comprise an array of nucleic acid sequences of fragments of about 15 nucleotides in length. In further embodiments, the chip may comprise an array including at least one of the sequences selected from the group consisting of SEQ ID Nos. 1–70, 72–654 except SEQ ID Nos. 419–424, 490, 531 and 540 and the sequences complementary thereto, or more preferably SEQ ID Nos. 655–724, 726–1304 except SEQ ID Nos. 1073–1078, 1144, 1185, 1194 and the sequences complementary thereto, or a fragment thereof at least about 8 consecutive nucleotides, preferably 10, 15, 20, more preferably 25, 30, 40, 47, or 50 consecutive nucleotides. In some embodiments, the chip may comprise an array of at least 2, 3, 4, 5, 6, 7, 8 or more of these polynucleotides of the invention. Solid supports and polynucleotides of the present invention attached to solid supports are further described in I. Biallelic Markers and Polynucleotides Comprising Biallelic Markers.

5. Integrated Systems

Another technique, which may be used to analyze polymorphisms, includes multicomponent integrated systems, which miniaturize and compartmentalize processes such as PCR and capillary electrophoresis reactions in a single functional device. An example of such technique is disclosed in U.S. Pat. No. 5,589,136, which describes the integration of PCR amplification and capillary electrophoresis in chips.

Integrated systems can be envisaged mainly when micro fluidic systems are used. These systems comprise a pattern of micro channels designed onto a glass, silicon, quartz, or plastic wafer included on a microchip. The movements of the samples are controlled by electric, electroosmotic or hydrostatic forces applied across different areas of the microchip. For genotyping biallelic markers, the microfluidic system may integrate nucleic acid amplification, microsequencing, capillary electrophoresis and a detection method such as laser-induced fluorescence detection.

IV. Methods of Genetic Analysis Using the Biallelic Markers of the Present Invention Different methods are available for the genetic analysis of complex traits (see Lander and Schork, Science, 265, 2037–2048, 1994). The search for disease-susceptibility genes is conducted using two main methods: the linkage approach in which evidence is sought for cosegregation between a locus and a putative trait locus using family studies, and the association approach in which evidence is sought for a statistically significant association between an allele and a trait or a trait causing allele (Khoury J. et al., Fundamentals of Genetic Epidemiology, Oxford University Press, NY, 1993). In general, the biallelic markers of the present invention find use in any method known in the art to demonstrate a statistically significant correlation between a genotype and a phenotype. The biallelic markers may be used in parametric and non-parametric linkage analysis methods. Preferably, the biallelic markers of the present invention are used to identify genes associated with detectable traits using association studies, an approach which does not require the use of affected families and which permits the identification of genes associated with complex and sporadic traits.

The genetic analysis using the biallelic markers of the present invention may be conducted on any scale. The whole set of biallelic markers of the present invention or any subset of biallelic markers of the present invention may be used. In some embodiments a subset of biallelic markers corresponding to one or several candidate genes of the present invention may be used. In other embodiments a subset of biallelic markers corresponding to candidate genes from a given pathway of arachidonic acid metabolism may be used. Such pathways include the cycloxygenase pathway and the lipoxygenase pathway. Alternatively, a subset of biallelic markers of the present invention localised on a specific chromosome segment may be used. Further, any set of genetic markers including a biallelic marker of the present invention may be used. A set of biallelic polymorphisms that, could be used as genetic markers in combination with the biallelic markers of the present invention, has been described in WO 98/20165. As mentioned above, it should be noted that the biallelic markers of the present invention may be included in any complete or partial genetic map of the human genome. These different uses are specifically contemplated in the present invention and claims.

A. Linkage Analysis

Linkage analysis is based upon establishing a correlation between the transmission of genetic markers and that of a specific trait throughout generations within a family. Thus, the aim of linkage analysis is to detect marker loci that show cosegregation with a trait of interest in pedigrees.

Parametric Methods

When data are available from successive generations there is the opportunity to study the degree of linkage between pairs of loci. Estimates of the recombination fraction enable loci to be ordered and placed onto a genetic map. With loci that are genetic markers, a genetic map can be established, and then the strength of linkage between markers and traits can be calculated and used to indicate the relative positions of markers and genes affecting those traits (Weir, B. S., Genetic data Analysis II: Methods for Discrete population genetic Data, Sinauer Assoc., Inc., Sunderland, Mass., USA, 1996). The classical method for linkage analysis is the logarithm of odds (lod) score method (see Morton N. E., Am. J. Hum. Genet., 7:277–318, 1955; Ott J., Analysis of Human Genetic Linkage, John Hopkins University Press, Baltimore, 1991). Calculation of lod scores requires specification of the mode of inheritance for the disease (parametric method). Generally, the length of the candidate region identified using linkage analysis is between 2 and 20 Mb. Once a candidate region is identified as described above, analysis of recombinant individuals using additional markers allows further delineation of the candidate region. Linkage analysis studies have generally relied on the use of a maximum of 5,000 microsatellite markers, thus limiting the maximum theoretical attainable resolution of linkage analysis to about 600 kb on average.

Linkage analysis has been successfully applied to map simple genetic traits that show clear Mendelian inheritance patterns and which have a high penetrance (i.e., the ratio between the number of affected carriers of allele a and the total number of a carriers in the population). However, parametric linkage analysis suffers from a variety of drawbacks. First, it is limited by its reliance on the choice of a genetic model suitable for each studied trait. Furthermore, as already mentioned, the resolution attainable using linkage analysis is limited, and complementary studies are required to refine the analysis of the typical 2 Mb to 20 Mb regions initially identified through linkage analysis. In addition, parametric linkage analysis approaches have proven difficult when applied to complex genetic traits, such as those due to the combined action of multiple genes and/or environmental factors. It is very difficult to model these factors adequately in a lod score analysis. In such cases, too large an effort and cost are needed to recruit the adequate number of affected families required for applying linkage analysis to these situations, as recently discussed by Risch, N. and Merikangas, K. (*Science*, 273:1516–1517, 1996).

Non-parametric Methods

The advantage of the so-called non-parametric methods for linkage analysis is that they do not require specification of the mode of inheritance for the disease, they tend to be more useful for the analysis of complex traits. In non-parametric methods, one tries to prove that the inheritance pattern of a chromosomal region is not consistent with random Mendelian segregation by showing that affected relatives inherit identical copies of the region more often than expected by chance. Affected relatives should show excess "allele sharing" even in the presence of incomplete penetrance and polygenic inheritance. In non-parametric linkage analysis the degree of agreement at a marker locus in two individuals can be measured either by the number of alleles identical by state (IBS) or by the number of alleles identical by descent (IBD). Affected sib pair analysis is a well-known special case and is the simplest form of these methods.

The biallelic markers of the present invention may be used in both parametric and non-parametric linkage analysis. Preferably biallelic markers may be used in non-parametric methods which allow the mapping of genes involved in complex traits. The biallelic markers of the present invention may be used in both IBD- and IBS-methods to map genes affecting a complex trait. In such studies, taking advantage of the high density of biallelic markers, several adjacent biallelic marker loci may be pooled to achieve the efficiency attained by multi-allelic markers (Zhao et al., *Am. J. Hum. Genet.*, 63:225–240, 1998).

However, both parametric and non-parametric linkage analysis methods analyse affected relatives, they tend to be of limited value in the genetic analysis of drug responses or in the analysis of side effects to treatments. This type of analysis is impractical in such cases due to the lack of availability of familial cases. In fact, the likelihood of having more than one individual in a family being exposed to the same drug at the same time is extremely low.

B. Population Association Studies

The present invention comprises methods for identifying one or several genes among a set of candidate genes that are associated with a detectable trait using the biallelic markers of the present invention. In one embodiment the present invention comprises methods to detect an association between a biallelic marker allele or a biallelic marker haplotype and a trait. Further, the invention comprises methods to identify a trait causing allele in linkage disequilibrium with any biallelic marker allele of the present invention.

As described above, alternative approaches can be employed to perform association studies: genome-wide association studies, candidate region association studies and candidate gene association studies. In a preferred embodiment, the biallelic markers of the present invention are used to perform candidate gene association studies. The candidate gene analysis clearly provides a short-cut approach to the identification of genes and gene polymorphisms related to a particular trait when some information concerning the biology of the trait is available. Further, the biallelic markers of the present invention may be incorporated in any map of genetic markers of the human genome in order to perform genome-wide association studies. Methods to generate a high-density map of biallelic markers have been described in WIPO Patent application serial number PCT/IB98/01193. The biallelic markers of the present invention may further be incorporated in any map of a specific candidate region of the genome (a specific chromosome or a specific chromosomal segment for example).

As mentioned above, association studies may be conducted within the general population and are not limited to studies performed on related individuals in affected families. Association studies are extremely valuable as they permit the analysis of sporadic or multifactor traits. Moreover, association studies represent a powerful method for fine-scale mapping enabling much finer mapping of trait causing alleles than linkage studies. Studies based on pedigrees often only narrow the location of the trait causing allele. Association studies using the biallelic markers of the present invention can therefore be used to refine the location of a trait causing allele in a candidate region identified by Linkage Analysis methods. Moreover, once a chromosome segment of interest has been identified, the presence of a candidate gene such as a candidate gene of the present invention, in the region of interest can provide a shortcut to the identification of the trait causing allele. Biallelic markers of the present invention can be used to demonstrate that a candidate gene is associated with a trait. Such uses are specifically contemplated in the present invention and claims.

1. Determining the Frequency of a Biallelic Marker Allele or of a Biallelic Marker Haplotype in a Population Association studies explore the relationships among frequencies for sets of alleles between loci. In addition, the present invention provides methods of determining the frequency in a population of an allele of a 12-LO-related biallelic marker comprising: a) genotyping individuals from said population for said biallelic marker and, b) determining the proportional representation of said biallelic marker in said population. Optionally, said 12-LO-related biallelic marker is selected from the biallelic markers described in Table 2(a–c). The present invention further provides methods of estimating the frequency of a haplotype for a set of biallelic markers in a population, comprising: a) genotyping each individual in said population for at least one 12-LO-related biallelic marker; b) genotyping each individual in said population for a second biallelic marker by determining the identity of the nucleotides at said second biallelic marker for both copies of said second biallelic marker present in the genome; and c) applying a haplotype determination method to the identities of the nucleotides determined in steps a) and b) to obtain an estimate of said frequency. Optionally, said haplotype determination method is selected from asymmetric PCR amplification, double PCR amplification of specific alleles, the Clark method, or an expectation maximization algorithm. Optionally, said 12-LO-related biallelic marker is selected from the biallelic markers described in Table 2(a–c).

Determining the Frequency of an Allele in a Population

Allelic frequencies of the biallelic markers in a population can be determined using one of the methods described above under the heading "Methods for genotyping an individual for biallelic markers," or any genotyping procedure suitable for this intended purpose. Genotyping pooled samples or individual samples can determine the frequency of a biallelic marker allele in a population. One way to reduce the number of genotypings required is to use pooled samples. A major obstacle in using pooled samples is in terms of accuracy and reproducibility for determining accurate DNA concentrations in setting up the pools. Genotyping individual samples provides higher sensitivity, reproducibility and accuracy and; is the preferred method used in the present invention. Preferably, each individual is genotyped separately and simple gene counting is applied to determine the frequency of an allele of a biallelic marker or of a genotype in a given population.

Determining the Frequency of a Haplotype in a Population

The gametic phase of haplotypes is unknown when diploid individuals are heterozygous at more than one locus. Using genealogical information in families gametic phase can sometimes be inferred (Perlin et al., *Am. J. Hum. Genet.*, 55:777–787, 1994). When no genealogical information is available different strategies may be used. One possibility is that the multiple-site heterozygous diploids can be eliminated from the analysis, keeping only the homozygotes and the single-site heterozygote individuals, but this approach might lead to a possible bias in the sample composition and the underestimation of low-frequency haplotypes. Another possibility is that single chromosomes can be studied independently, for example, by asymmetric PCR amplification (see Newton et al., *Nucleic Acids Res.*, 17:2503–2516, 1989; Wu et al., *Proc. Natl. Acad. Sci. USA*, 86:2757, 1989) or by isolation of single chromosome by limit dilution followed by PCR amplification (see Ruano et al., *Proc. Natl. Acad. Sci. USA*, 87:6296–6300, 1990). Further, a sample may be haplotyped for sufficiently close biallelic markers by double PCR amplification of specific alleles (Sarkar, G. and Sommer S. S., *Biotechniques*, 1991). These approaches are not entirely satisfying either because of their technical complexity, the additional cost they entail, their lack of generalisation at a large scale, or the possible biases they introduce. To overcome these difficulties, an algorithm to infer the phase of PCR-amplified DNA genotypes introduced by Clark A. G. (*Mol. Biol. Evol.*, 7:111–122, 1990) may be used. Briefly, the principle is to start filling a preliminary list of haplotypes present in the sample by examining unambiguous individuals, that is, the complete homozygotes and the single-site heterozygotes. Then other individuals in the same sample are screened for the possible occurrence of previously recognised haplotypes. For each positive identification, the complementary haplotype is added to the list of recognised haplotypes, until the phase information for all individuals is either resolved or identified as unresolved. This method assigns a single haplotype to each multiheterozygous individual, whereas several haplotypes are possible when there are more than one heterozygous site. Alternatively, one can use methods estimating haplotype frequencies in a population without assigning haplotypes to each individual. Preferably, a method based on an expectation-maximization (EM) algorithm (Dempster et al., *J. R. Stat. Soc.*, 39B: 1–38, 1977) leading to maximum-likelihood estimates of haplotype frequencies under the assumption of Hardy-Weinberg proportions (random mating) is used (see Excoffier L. and Slatkin M., *Mol. Biol. Evol.*, 12(5): 921–927, 1995). The EM algorithm is a generalised iterative maximum-likelihood approach to estimation that is useful when data are ambiguous and/or incomplete. The EM algorithm is used to resolve heterozygotes into haplotypes. Haplotype estimations are further described below under the heading "Statistical methods". Any other method known in the art to determine or to estimate the frequency of a haplotype in a population may also be used.

2. Linkage Disequilibrium Analysis.

Linkage disequilibrium is the non-random association of alleles at two or more loci and represents a powerful tool for mapping genes involved in disease traits (see Ajioka R. S. et al., *Am. J. Hum. Genet.*, 60:1439–1447, 1997). Biallelic markers, because they are densely spaced in the human genome and can be genotyped in more numerous numbers than other types of genetic markers (such as RFLP or VNTR markers), are particularly useful in genetic analysis based on linkage disequilibrium. The biallelic markers of the present invention may be used in any linkage disequilibrium analysis method known in the art.

When a disease mutation is first introduced into a population (by a new mutation or the immigration of a mutation carrier), it necessarily resides on a single chromosome and thus on a single "background" or "ancestral" haplotype of linked markers. Consequently, there is complete disequilibrium between these markers and the disease mutation: one finds the disease mutation only in the presence of a specific set of marker alleles. Through subsequent generations recombinations occur between the disease mutation and these marker polymorphisms, and the disequilibrium gradually dissipates. The pace of this dissipation is a function of the recombination frequency, so the markers closest to the disease gene will manifest higher levels of disequilibrium than those that are further away. When not broken up by recombination, "ancestral" haplotypes and linkage disequilibrium between marker alleles at different loci can be tracked not only through pedigrees but also through populations. Linkage disequilibrium is usually seen as an association between one specific allele at one locus and another specific allele at a second locus.

The pattern or curve of disequilibrium between disease and marker loci is expected to exhibit a maximum that occurs at the disease locus. Consequently, the amount of linkage disequilibrium between a disease allele and closely linked genetic markers may yield valuable information regarding the location of the disease gene. For fine-scale mapping of a disease locus, it is useful to have some knowledge of the patterns of linkage disequilibrium that exist between markers in the studied region. As mentioned above the mapping resolution achieved through the analysis of linkage disequilibrium is much higher than that of linkage studies. The high density of biallelic markers combined with linkage disequilibrium analysis provides powerful tools for fine-scale mapping. Different methods to calculate linkage disequilibrium are described below under the heading "Statistical Methods".

3. Population-based Case-control Studies of Trait-marker Associations.

As mentioned above, the occurrence of pairs of specific alleles at different loci on the same chromosome is not random and the deviation from random is called linkage disequilibrium. Association studies focus on population frequencies and rely on the phenomenon of linkage disequilibrium. If a specific allele in a given gene is directly involved in causing a particular trait, its frequency will be statistically increased in an affected (affected) population, when compared to the frequency in a trait negative population or in a random control population. As a consequence of the existence of linkage disequilibrium, the frequency of all other alleles present in the haplotype carrying the trait-causing allele will also be increased in affected (affected) individuals compared to trait negative individuals or random controls. Therefore, association between the trait and any allele (specifically a biallelic marker allele) in linkage disequilibrium with the trait-causing allele will suffice to suggest the presence of a trait-related gene in that particular region. Case-control populations can be genotyped for biallelic markers to identify associations that narrowly locate a trait causing allele. As any marker in linkage disequilibrium with one given marker associated with a trait will be associated with the trait. Linkage disequilibrium allows the relative frequencies in case-control populations of a limited number of genetic polymorphisms (specifically biallelic markers) to be analysed as an alternative to screening all possible functional polymorphisms in order to find trait-causing alleles. Association studies compare the frequency of marker alleles in unrelated case-control populations, and represent powerful tools for the dissection of complex traits.

Case-control Populations (Inclusion Criteria)

Population-based association studies do not concern familial inheritance but compare the prevalence of a particular genetic marker, or a set of markers, in case-control populations. They are case-control studies based on comparison of unrelated case (affected or affected) individuals and unrelated control (unaffected or trait negative or random) individuals. Preferably the control group is composed of unaffected or trait negative individuals. Further, the control group is ethnically matched to the case population. Moreover, the control group is preferably matched to the case-population for the main known confusion factor for the trait under study (for example age-matched for an age-dependent trait). Ideally, individuals in the two samples are paired in such a way that they are expected to differ only in their disease status. In the following "affected population", "case population" and "affected population" are used interchangeably.

An important step in the dissection of complex traits using association studies is the choice of case-control populations (see Lander and Schork, *Science*, 265, 2037–2048, 1994). A major step in the choice of case-control populations is the clinical definition of a given trait or phenotype. Any genetic trait may be analysed by the association method proposed here by carefully selecting the individuals to be included in the affected and control phenotypic groups. Four criteria are often useful: clinical phenotype, age at onset, family history and severity. The selection procedure for continuous or quantitative traits (such as blood pressure for example) involves selecting individuals at opposite ends of the phenotype distribution of the trait under study, so as to include in these affected and control individuals with non-overlapping phenotypes. Preferably, case-control populations consist of phenotypically homogeneous populations. Affected and control populations consist of phenotypically uniform populations of individuals representing each between 1 and 98%, preferably between 1 and 80%, more preferably between 1 and 50%, and more preferably between 1 and 30%, most preferably between 1 and 20% of the total population under study, and selected among individuals exhibiting non-overlapping phenotypes. The clearer the difference between the two trait phenotypes, the greater the probability of detecting an association with biallelic markers. The selection of those drastically different but relatively uniform phenotypes enables efficient comparisons in association studies and the possible detection of marked differences at the genetic level, provided that the sample sizes of the populations under study are significant enough.

In preferred embodiments, a first group of between 50 and 300 affected individuals, preferably about 100 individuals, are recruited according to their phenotypes. A similar number of trait negative individuals are included in such studies.

In the present invention, typical examples of inclusion criteria include a disease involving arachidonic acid metabolism or the evaluation of the response to a drug acting on arachidonic acid metabolism or side effects to treatment with drugs acting on arachidonic acid metabolism.

Suitable examples of association studies using biallelic markers including the biallelic markers of the present invention, are studies involving the following populations:
- a case population suffering from a disease involving arachidonic acid metabolism and a healthy unaffected control population, or
- a case population treated with agents acting on arachidonic acid metabolism suffering from side-effects resulting from the treatment and a control population treated with the same agents showing no side-effects, or
- a case population treated with agents acting on arachidonic acid metabolism showing a beneficial response and a control population treated with same agents showing no beneficial response.

In a preferred embodiment, eicosanoid related-markers may be used to identify individuals who are prone to hepatoxicity as a result of drug treatment. This includes diagnostic and prognostic assays to identify individuals who are prone to liver toxicity as a result of drug treatment, as well as clinical trials and treatment regimes which utilize these assays. Said drug treatment may include any pharmaceutical compound suspected or known in the art to result in an increased level of hepatoxicity.

In another preferred embodiment, the trait considered was a side effect upon drug treatment; the study involved two populations derived from a clinical study of the anti-asthmatic drug zileuton. The case population was composed of asthmatic individuals treated with Zileuton showing zileuton-associated hepatotoxicity monitored by the serum level of alanine aminotransferase (ALT) and the control population was composed of asthmatic individuals treated with zileuton and having no increased serum level of ALT. Inclusion criteria and association between the biallelic markers of the present invention and zileuton-associated hepatotoxicity are further described below in IV.E. Association of Biallelic Markers of the Invention with Hepatoxicity to Anti-Asthma Drug Zileuton and in Example 5, Association between Side Effects upon Treatment with the Anti-Asthmatic Drug Zileuton (Zyflo™) and the Biallelic Markers of the 12-lipoxygenase Gene.

Association Analysis

The general strategy to perform association studies using biallelic markers derived from a region carrying a candidate gene is to scan two groups of individuals (case-control populations) in order to measure and statistically compare the allele frequencies of the biallelic markers of the present invention in both groups.

If a statistically significant association with a trait is identified for at least one or more of the analysed biallelic markers, one can assume that: either the associated allele is directly responsible for causing the trait (the associated allele is the trait causing allele), or more likely the associated allele is in linkage disequilibrium with the trait causing allele. The specific characteristics of the associated allele with respect to the candidate gene function usually gives further insight into the relationship between the associated allele and the trait (causal or in linkage disequilibrium). If the evidence indicates that the associated allele within the candidate gene is most probably not the trait causing allele but is in linkage disequilibrium with the real trait causing allele, then the trait causing allele can be found by sequencing the vicinity of the associated marker.

Association studies are usually run in two successive steps. In a first phase, the frequencies of a reduced number of biallelic markers from one or several candidate genes are determined in the affected and control populations. In a second phase of the analysis, the identity of the candidate gene and the position of the genetic loci responsible for the given trait is further refined using a higher density of markers from the relevant region. However, if the candidate gene under study is relatively small in length, as it is the case for many of the candidate genes analysed included in the present invention, a single phase may be sufficient to establish significant associations.

Haplotype Analysis

As described above, when a chromosome carrying a disease allele first appears in a population as a result of either mutation or migration, the mutant allele necessarily resides on a chromosome having a set of linked markers: the ancestral haplotype. This haplotype can be tracked through populations and its statistical association with a given trait can be analysed. Complementing single point (allelic) association studies with multi-point association studies also called haplotype studies increases the statistical power of association studies. Thus, a haplotype association study allows one to define the frequency and the type of the ancestral carrier haplotype. A haplotype analysis is important in that it increases the statistical power of an analysis involving individual markers.

In a first stage of a haplotype frequency analysis, the frequency of the possible haplotypes based on various combinations of the identified biallelic markers of the invention is determined. The haplotype frequency is then compared for distinct populations of affected and control individuals. The number of affected individuals, which should be, subjected to this analysis to obtain statistically significant results usually ranges between 30 and 300, with a preferred number of individuals ranging between 50 and 150. The same considerations apply to the number of unaffected individuals (or random control) used in the study. The results of this first analysis provide haplotype frequencies in case-control populations, for each evaluated haplotype frequency a p-value and an odd ratio are calculated. If a statistically significant association is found the relative risk for an individual carrying the given haplotype of being affected with the trait under study can be approximated.

Interaction Analysis

The biallelic markers of the present invention may also be used to identify patterns of biallelic markers associated with detectable traits resulting from polygenic interactions. The analysis of genetic interaction between alleles at unlinked loci requires individual genotyping using the techniques described herein. The analysis of allelic interaction among a selected set of biallelic markers with appropriate level of statistical significance can be considered as a haplotype analysis. Interaction analysis consists in stratifying the case-control populations with respect to a given haplotype for the first loci and performing a haplotype analysis with the second loci with each subpopulation.

Statistical methods used in association studies are further described below in IV.C "Statistical Methods."

4. Testing for Linkage in the Presence of Association.

The biallelic markers of the present invention may further be used in TDT (transmission/disequilibrium test). TDT tests for both linkage and association and is not affected by population stratification. TDT requires data for affected individuals and their parents or data from unaffected sibs instead of from parents (see Spielmann S. et al., *Am. J. Hum. Genet.*, 52:506–516, 1993; Schaid D. J. et al., *Genet. Epidemiol.*, 13:423–450, 1996, Spielmann S. and Ewens W. J., *Am. J. Hum. Genet.*, 62:450–458, 1998). Such combined tests generally reduce the false—positive errors produced by separate analyses.

C. Statistical Methods

In general, any method known in the art to test whether a trait and a genotype show a statistically significant correlation may be used.

1. Methods in Linkage Analysis.

Statistical methods and computer programs useful for linkage analysis are well-known to those skilled in the art (see Terwilliger J. D. and Ott J., *Handbook of Human Genetic Linkage*, John Hopkins University Press, London, 1994; Ott J., *Analysis of Human Genetic Linkage*, John Hopkins University Press, Baltimore, 1991).

2. Methods to Estimate Haplotype Frequencies in a Population.

As described above, when genotypes are scored, it is often not possible to distinguish heterozygotes so that haplotype frequencies cannot be easily inferred. When the gametic phase is not known, haplotype frequencies can be estimated from the multilocus genotypic data. Any method known to person skilled in the art can be used to estimate haplotype frequencies (see Lange K., *Mathematical and Statistical Methods for Genetic Analysis*, Springer, N.Y., 1997; Weir, B. S., *Genetic data Analysis II: Methods for Discrete population genetic Data*, Sinauer Assoc., Inc., Sunderland, Mass., USA, 1996) Preferably, maximum-likelihood haplotype frequencies are computed using an Expectation-Maximization (EM) algorithm (see Dempster et al., J. R. Stat. Soc., 39B:1–38, 1977; Excoffier L. and Slatkin M., *Mol. Biol. Evol.*, 12(5): 921–927, 1995). This procedure is an iterative process aiming at obtaining maximum-likelihood estimates of haplotype frequencies from multi-locus genotype data when the gametic phase is unknown. Haplotype estimations are usually performed by applying the EM algorithm using for example the EM-HAPLO program (Hawley M. E. et al., *Am. J. Phys. Anthropol.*, 18:104, 1994) or the Arlequin program (Schneider et al., *Arlequin: a software for population genetics data analysis*, University of Geneva, 1997). The EM algorithm is a generalised iterative maximum likelihood approach to estimation and is briefly described below.

In what follows, phenotypes will refer to multi-locus genotypes with unknown haplotypic phase. Genotypes will refer to mutli-locus genotypes with known haplotypic phase.

Suppose one has a sample of N unrelated individuals typed for K markers. The data observed are the unknown-phase K-locus phenotypes that can be categorized with F different phenotypes. Further, suppose that we have H possible haplotypes (in the case of K biallelic markers, we have for the maximum number of possible haplotypes $H=2^K$).

For phenotype j with $c_j$ possible genotypes, we have:

$$P_j = \sum_{i=1}^{c_j} P(\text{genotype}(i)) = \sum_{i=1}^{c_j} P(h_k, h_l). \qquad \text{Equation 1}$$

Here, $P_j$ is the probability of the $j^{th}$ phenotype, and $P(h_k, h_l)$ is the probability of the $i^{th}$ genotype composed of haplotypes $h_k$ and $h_l$. Under random mating (i.e. Hardy-Weinberg Equilibrium), $P(h_k, h_l)$ is expressed as:

$$P(h_k, h_l) = P(h_k)^2 \text{ for } h_k = h_l, \text{ and}$$
$$P(h_k, h_l) = 2P(h_k)P(h_l) \text{ for } h_k \neq h_l. \qquad \text{Equation 2}$$

The E-M algorithm is composed of the following steps: First, the genotype frequencies are estimated from a set of initial values of haplotype frequencies. These haplotype frequencies are denoted $P_1^{(0)}, P_2^{(0)}, P_3^{(0)}, \ldots, P_H^{(0)}$. The initial values for the haplotype frequencies may be obtained from a random number generator or in some other way well known in the art. This step is referred to the Expectation step. The next step in the method, called the Maximization step, consists of using the estimates for the genotype frequencies to re-calculate the haplotype frequencies. The first iteration haplotype frequency estimates are denoted by $P_1^{(1)}$, $P_2^{(1)}, P_3^{(1)}, \ldots, P_H^{(1)}$. In general, the Expectation step at the $s^{th}$ iteration consists of calculating the probability of placing each phenotype into the different possible genotypes based on the haplotype frequencies of the previous iteration:

$$P(h_k, h_l)^{(s)} = \frac{n_j}{N}\left[\frac{P_j(h_k, h_l)^{(s)}}{P_j}\right], \quad \text{Equation 3}$$

where $n_j$ is the number of individuals with the $j^{th}$ phenotype and $P_j(h_k, h_l)^{(s)}$ is the probability of genotype $h_k, h_l$ in phenotype j. In the Maximization step, which is equivalent to the gene-counting method (Smith, *Ann. Hum. Genet.*, 21:254–276, 1957), the haplotype frequencies are re-estimated based on the genotype estimates:

$$P_t^{(s+1)} = \frac{1}{2}\sum_{j=1}^{F}\sum_{i=1}^{c_j}\delta_{it}P_j(h_k, h_l)^{(s)}. \quad \text{Equation 4}$$

Here, $\delta_{it}$ is an indicator variable which counts the number of occurrences that haplotype t is present in $i^{th}$ genotype; it takes on values 0, 1, and 2.

The E-M iterations cease when the following criterion has been reached. Using Maximum Likelihood Estimation (MLE) theory, one assumes that the phenotypes j are distributed multinomially. At each iteration s, one can compute the likelihood function L. Convergence is achieved when the difference of the log-likehood between two consecutive iterations is less than some small number, preferably $10^{-7}$.

3. Methods to Calculate Linkage Disequilibrium between Markers.

A number of methods can be used to calculate linkage disequilibrium between any two genetic positions, in practice linkage disequilibrium is measured by applying a statistical association test to haplotype data taken from a population.

Linkage disequilibrium between any pair of biallelic markers comprising at least one of the biallelic markers of the present invention ($M_i$, $M_j$) having alleles ($a_i/b_i$) at marker $M_i$ and alleles ($a_j/b_j$) at marker $M_j$ can be calculated for every allele combination ($a_i,a_j$; $a_i,b_j$; $b_i,a_j$ and $b_i,b_j$), according to the Piazza formula:

$$\Delta_{aiaj}=\sqrt{\theta4}-\sqrt{(\theta4+\theta3)(\theta4+\theta2)},$$

where:

θ4=−−=frequency of genotypes not having allele $a_i$ at $M_i$ and not having allele $a_j$ at $M_j$ θ3=−+=frequency of genotypes not having allele $a_i$ at $M_i$ and having allele $a_j$ at $M_j$ θ2=+−=frequency of genotypes having allele $a_i$ at $M_i$ and not having allele $a_j$ at $M_j$ Linkage disequilibrium (LD) between pairs of biallelic markers ($M_i$, $M_j$) can also be calculated for every allele combination (ai,aj; ai,bj; $b_i,a_j$ and $b_i,b_j$), according to the maximum-likelihood estimate (MLE) for delta (the composite genotypic disequilibrium coefficient), as described by Weir (Weir B. S., *Genetic Data Analysis*, Sinauer Ass. Eds, 1996). The MLE for the composite linkage disequilibrium is:

$$D_{aiaj}=(2n_1+n_2+n_3+n_4/2)/N-2(pr(a_i)\cdot pr(a_j))$$

Where $n_1=\Sigma$ phenotype ($a_i/a_i$, $a_j/a_j$), $n_2=\Sigma$ phenotype ($a_i/a_i$, $a_j/b_j$), $n_3=\Sigma$ phenotype ($a_i/b_i$, $a_j/a_j$), n4=Σ phenotype ($a_i/b_i$, $a_j/b_j$) and N is the number of individuals in the sample.

This formula allows linkage disequilibrium between alleles to be estimated when only genotype, and not haplotype, data are available.

Another means of calculating the linkage disequilibrium between markers is as follows. For a couple of biallelic markers, $M_i$ ($a_i/b_i$) and $M_j$ ($a_j/b_j$), fitting the Hardy-Weinberg equilibrium, one can estimate the four possible haplotype frequencies in a given population according to the approach described above.

The estimation of gametic disequilibrium between ai and aj is simply:

$$D_{aiaj}=pr(\text{haplotype}(a_i,a_j))-pr(a_i)\cdot pr(a_j).$$

Where $pr(a_i)$ is the probability of allele $a_i$ and $pr(a_j)$ is the probability of allele $a_j$ and where pr(haplotype ($a_i$, $a_j$)) is estimated as in Equation 3 above.

For a couple of biallelic marker only one measure of disequilibrium is necessary to describe the association between $M_i$ and $M_j$.

Then a normalised value of the above is calculated as follows:

$$D'_{aiaj}=D_{aiaj}/\max(-pr(a_i)\cdot pr(a_j),-pr(b_i)\cdot pr(b_j)) \text{ with } D_{aiaj}<0$$

$$D'_{aiaj}=D_{aiaj}/\max(-pr(b_i)\cdot pr(a_j),-pr(a_i)\cdot pr(b_j)) \text{ with } D_{aiaj}>0$$

The skilled person will readily appreciate that other LD calculation methods can be used without undue experimentation.

Linkage disequilibrium among a set of biallelic markers having an adequate heterozygosity rate can be determined by genotyping between 50 and 1000 unrelated individuals, preferably between 75 and 200, more preferably around 100.

4. Testing for Association.

Methods for determining the statistical significance of a correlation between a phenotype and a genotype, in this case an allele at a biallelic marker or a haplotype made up of such alleles, may be determined by any statistical test known in the art and with any accepted threshold of statistical significance being required. The application of particular methods and thresholds of significance are well with in the skill of the ordinary practitioner of the art.

Testing for association is performed by determining the frequency of a biallelic marker allele in case and control populations and comparing these frequencies with a statistical test to determine if their is a statistically significant difference in frequency which would indicate a correlation between the trait and the biallelic marker allele under study. Similarly, a haplotype analysis is performed by estimating the frequencies of all possible haplotypes for a given set of biallelic markers in case and control populations, and comparing these frequencies with a statistical test to determine if their is a statistically significant correlation between the haplotype and the phenotype (trait) under study. Any statistical tool useful to test for a statistically significant association between a genotype and a phenotype may be used. Preferably the statistical test employed is a chi-square test with one degree of freedom. A P-value is calculated (the P-value is the probability that a statistic as large or larger than the observed one would occur by chance).

Statistical Significance

In preferred embodiments, significance for diagnosis purposes, either as a positive basis for further diagnostic tests or as a preliminary starting point for early preventive therapy, the p value related to a biallelic marker association is preferably about $1\times10^{-2}$ or less, more preferably about $1\times10^{-4}$ or less, for a single biallelic marker analysis and about $1\times10^{-3}$ or less, still more preferably $1\times10^{-6}$ or less and most preferably of about $1\times10^{-8}$ or less, for a haplotype analysis involving several markers. These values are believed to be applicable to any association studies involving single or multiple marker combinations.

The skilled person can use the range of values set forth above as a starting point in order to carry out association studies with biallelic markers of the present invention. In doing so, significant associations between the biallelic markers of the present invention and diseases involving arachidonic acid metabolism can be revealed and used for diagnosis and drug screening purposes.

Phenotypic Permutation

In order to confirm the statistical significance of the first stage haplotype analysis described above, it might be suitable to perform further analyses in which genotyping data from case-control individuals are pooled and randomised with respect to the trait phenotype. Each individual genotyping data is randomly allocated to two groups, which contain the same number of individuals as the case-control populations used to compile the data obtained in the first stage. A second stage haplotype analysis is preferably run on these artificial groups, preferably for the markers included in the haplotype of the first stage analysis showing the highest relative risk coefficient. This experiment is reiterated preferably at least between 100 and 10000 times. The repeated iterations allow the determination of the percentage of obtained haplotypes with a significant p-value level.

Assessment of Statistical Association

To address the problem of false positives similar analysis may be performed with the same case-control populations in random genomic regions. Results in random regions and the candidate region are compared as described in U.S. Provisional Patent Application entitled "Methods, software and apparati for identifying genomic regions harbouring a gene associated with a detectable trait".

5. Evaluation of Risk Factors.

The association between a risk factor (in genetic epidemiology the risk factor is the presence or the absence of a certain allele or haplotype at marker loci) and a disease is measured by the odds ratio (OR) and by the relative risk (RR). If $P(R^+)$ is the probability of developing the disease for individuals with R and $P(R^-)$ is the probability for individuals without the risk factor, then the relative risk is simply the ratio of the two probabilities, that is:

$$RR = P(R^+)/P(R^-)$$

In case-control studies, direct measures of the relative risk cannot be obtained because of the sampling design. However, the odds ratio allows a good approximation of the relative risk for low-incidence diseases and can be calculated:

$$OR = \left[\frac{F^+}{1-F^+}\right] / \left[\frac{F^-}{(1-F^-)}\right]$$

$F^+$ is the frequency of the exposure to the risk factor in cases and $F^-$ is the frequency of the exposure to the risk factor in controls. $F^+$ and $F^-$ are calculated using the allelic or haplotype frequencies of the study and further depend on the underlying genetic model (dominant, recessive, additive . . . ).

One can further estimate the attributable risk (AR) which describes the proportion of individuals in a population exhibiting a trait due to a given risk factor. This measure is important in quantitating the role of a specific factor in disease etiology and in terms of the public health impact of a risk factor. The public health relevance of this measure lies in estimating the proportion of cases of disease in the population that could be prevented if the exposure of interest were absent. AR is determined as follows:

$$AR = P_E(RR-1)/(P_E(RR-1)+1)$$

AR is the risk attributable to a biallelic marker allele or a biallelic marker haplotype. $P_E$ is the frequency of exposure to an allele or a haplotype within the population at large; and RR is the relative risk which, is approximated with the odds ratio when the trait under study has a relatively low incidence in the general population.

D. Association of Biallelic Markers of the Invention with Asthma

In the context of the present invention, an association between biallelic marker alleles from candidate genes of the present invention and a disease linked to arachidonic acid metabolism was demonstrated. The considered trait was asthma.

Asthma affects over 5% of the population in industrialized countries. It is increasing in prevalence and severity and has a rising mortality (Rang H. P., Ritter J. M. and Dale M. M.; *Pharmacology*; Churchill Livingstone, N.Y., 1995). Bronchial asthma is a multifactorial syndrome rather than a single disease, defined as airway obstruction characterized by inflammatory changes in the airways and bronchial hyper-responsiveness. In addition to the evidenced impact of environmental factors on the development of asthma, patterns of clustering and segregation in asthmatic families have suggested a genetic component to asthma. However the lack of a defined and specific asthma phenotype and of suitable markers for genetic analysis is proving to be a major hurdle for reliably identifying genes associated with asthma. The identification of genes implicated in asthma would represent a major step towards the identification of new molecular targets for the development of anti-asthma drugs. Moreover there is no straightforward physiological or biological blood test for the asthmatic state. As a result, adequate asthma treatment is often delayed, thereby allowing the inflammation process to better establish itself. Thus, there is a need for the identification of asthma susceptibility genes in order to develop an efficient and reliable asthma diagnostic test.

As mentioned above, products of arachidonic acid metabolism are important inflammatory mediators and have been involved in a number of inflammatory diseases including asthma. More specifically, prostaglandins and leukotrienes are thought to play a major role in the inflammatory process observed in asthma patients.

In order to investigate and identify a genetic origin to asthma a candidate gene scan for asthma was conducted. The rational of this approach was to: 1) select candidate genes potentially involved in the pathological pathway of interest, in this case arachidonic acid metabolism, 2) to identify biallelic markers in those genes and finally 3) to measure the frequency of biallelic marker alleles in order to determine if some alleles are more frequent in asthmatic populations than in non-affected populations. Results were further validated by haplotype studies. Significant associations between biallelic marker alleles from the FLAP and 12-LO genes and asthma were demonstrated in the context of the present invention. Association studies are further described in Examples 3 and 4.

This information is extremely valuable. The knowledge of a potential genetic predisposition, even if this predisposition is not absolute, might contribute in a very significant manner to treatment efficacy of asthma patients and to the development of diagnostic tools.

E. Association of Biallelic Markers of the Invention with Hepatotoxicity to Anti-Asthma Drug Zileuton (Zyflo™)

In the context of the present invention, an association between the 12-LO gene and side effects related to treatment with the anti-asthmatic drug zileuton was discovered.

As mentioned above, bronchial asthma is a multifactorial syndrome rather than a single disease, defined as airway obstruction characterized by inflammatory changes in the airways and bronchial hyper-responsiveness. Although initially reversible with bronchiodilators, airway obstruction becomes increasingly irreversible if treated poorly. Asthma management therefore relies on early and regular use of drugs that control the disease. As a consequence, there is a strong need for efficient and safe therapeutic opportunities for patients with asthma. There are two main categories of anti-asthmatic drugs—bronchodilators and anti-inflammatory agents. There is now general agreement on the need to implement early anti-inflammatory treatment rather than relying on symptomatic treatment with bronchiodilators alone. The leukotrienes, a family of proinflammatory mediators arising via arachidonic acid metabolism, have been implicated in the inflammatory cascade that occurs in asthmatic airways. Of great relevance to the pathogenesis of asthma is the 5-lipoxygenase, which catalyzes the initial step in the biosynthesis of leukotrienes from arachidonic acid. Given the significant role of the inflammatory process in asthma, pharmacological agents, such as leukotriene antagonists and 5-lipoxygenase inhibitors have been developed.

Zileuton (Zyflo™) is an active inhibitor of 5-lipoxygenase, the enzyme that catalyzes the formation of leukotrienes from arachidonic acid, indicated for prophylaxis and chronic treatment of asthma. A minority of zileuton-treated patients develop liver function abnormalities. Close monitoring revealed that elevations of liver function tests may occur during treatment with zileuton. The ALT test (serum level of alanine aminotransferase) was used, which is considered the most sensitive indicator of liver injury.

In order to investigate and identify a genetic origin to zileuton-associated hepatotoxicity, a candidate gene scan was conducted. This approach comprised:

selecting candidate genes potentially involved in the pathological pathway of interest or in the metabolism of zileuton, and identifying biallelic markers in those genes, and finally conducting association studies to identify biallelic marker alleles or haplotypes associated with elevations of liver function tests upon treatment with zileuton.

An association between elevated ALT levels upon treatment with zileuton and biallelic marker alleles from the 12-LO gene was demonstrated. Further details concerning this association study are provided in Example 5.

F. Identification of Biallelic Markers in Linkage Disequilibrium with the Biallelic Markers of the Invention Once a first biallelic marker has been identified in a genomic region of interest, the practitioner of ordinary skill in the art, using the teachings of the present invention, can easily identify additional biallelic markers in linkage disequilibrium with this first marker. As mentioned before any marker in linkage disequilibrium with a first marker associated with a trait will be associated with the trait. Therefore, once an association has been demonstrated between a given biallelic marker and a trait, the discovery of additional biallelic markers associated with this trait is of great interest in order to increase the density of biallelic markers in this particular region. The causal gene or mutation will be found in the vicinity of the marker or set of markers showing the highest correlation with the trait.

Identification of additional markers in linkage disequilibrium with a given marker involves: (a) amplifying a genomic fragment comprising a first biallelic marker from a plurality of individuals; (b) identifying of second biallelic markers in the genomic region harboring said first biallelic marker; (c) conducting a linkage disequilibrium analysis between said first biallelic marker and second biallelic markers; and (d) selecting said second biallelic markers as being in linkage disequilibrium with said first marker. Subcombinations comprising steps (b) and (c) are also contemplated.

Methods to identify biallelic markers and to conduct linkage disequilibrium analysis are described herein and can be carried out by the skilled person without undue experimentation. The present invention then also concerns biallelic markers which are in linkage disequilibrium with the specific biallelic markers shown in Table 7(A–B) and which are expected to present similar characteristics in terms of their respective association with a given trait.

G. Identification of Functional Mutations

Once a positive association is confirmed with a biallelic marker of the present invention, the associated candidate gene can be scanned for mutations by comparing the sequences of a selected number of affected individuals and control individuals. In a preferred embodiment, functional regions such as exons and splice sites, promoters and other regulatory regions of the candidate gene are scanned for mutations. Preferably, affected individuals carry the haplotype shown to be associated with the trait and trait negative or control individuals do not carry the haplotype or allele associated with the trait. The mutation detection procedure is essentially similar to that used for biallelic site identification.

The method used to detect such mutations generally comprises the following steps: (a) amplification of a region of the candidate gene comprising a biallelic marker or a group of biallelic markers associated with the trait from DNA samples of affected patients and trait negative controls;

(b) sequencing of the amplified region;

(c) comparison of DNA sequences from affected trait-positive patients and trait-negative controls; and (d) determination of mutations specific to affected trait-positive patients. Subcombinations which comprise steps (b) and (c) are specifically contemplated.

It is preferred that candidate polymorphisms be then verified by screening a larger population of cases and controls by means of any genotyping procedure such as those described herein, preferably using a microsequencing technique in an individual test format. Polymorphisms are considered as candidate mutations when present in cases and controls at frequencies compatible with the expected association results.

Identification of mutations and low frequency polymorphisms in the 5' flanking region of the 12-LO gene, in the exons and introns of the 12-LO gene and in the 3' flanking region of the 12-LO gene is further described in Example 5. Forty-nine low frequency polymorphisms and mutations were identified in the region of the 12-LO gene that was scanned. Low frequency polymorphisms and mutations identified in exons 5, 6, 8, and 13 are associated with amino acid substitutions at the polypeptide level. In each of these amino acid substitutions the original residue is replaced by a non-equivalent amino acid presenting different chemical properties. As a consequence, specificity, activity and function of the 12-LO enzyme are modified. Biallelic marker 10-343-231 is associated with a frame shift in the open reading frame of the 12-LO gene leading to the expression of a variant 12-LO polypeptide comprising only 131 amino acids. This mutant 12-LO enzyme is probably inactive or shows differences in specificity, activity and function. Biallelic marker 10-343-231 is associated with the deletion of a Leu residue in the 12-LO polypeptide.

Candidate polymorphisms and mutations of the 12-LO gene suspected of being responsible for the detectable phenotype, such as hepatoxicity to zileuton or asthma, can be confirmed by screening a larger population of affected and unaffected individuals using any of the genotyping procedures described herein. Preferably the microsequencing technique is used. Such polymorphisms are considered as candidate "trait-causing" mutations when they exhibit a statistically significant correlation with the detectable phenotype.

V. Biallelic Markers of the Invention in Methods of Genetic Diagnostics

The biallelic markers of the present invention can also be used to develop diagnostics tests capable of identifying individuals who express a detectable trait as the result of a specific genotype or individuals whose genotype places them at risk of developing a detectable trait at a subsequent time. The trait analyzed using the present diagnostics may be any detectable trait, including a disease involving arachidonic acid metabolism, a response to an agent acting on arachidonic acid metabolism or side effects to an agent acting on arachidonic acid metabolism.

The diagnostic techniques of the present invention may employ a variety of methodologies to determine whether a test subject has a biallelic marker pattern associated with an increased risk of developing a detectable trait or whether the individual suffers from a detectable trait as a result of a particular mutation, including methods which enable the analysis of individual chromosomes for haplotyping, such as family studies, single sperm DNA analysis or somatic hybrids.

The present invention provides diagnostic methods to determine whether an individual is at risk of developing a disease or suffers from a disease resulting from a mutation or a polymorphism in a candidate gene of the present invention. The present invention also provides methods to determine whether an individual is likely to respond positively to an agent acting on arachidonic acid metabolism or whether an individual is at risk of developing an adverse side effect to an agent acting on arachidonic acid metabolism.

These methods involve obtaining a nucleic acid sample from the individual and, determining, whether the nucleic acid sample contains at least one allele or at least one biallelic marker haplotype, indicative of a risk of developing the trait or indicative that the individual expresses the trait as a result of possessing a particular candidate gene polymorphism or mutation (trait-causing allele).

Preferably, in such diagnostic methods, a nucleic acid sample is obtained from the individual and this sample is genotyped using methods described above in III. Methods of Genotyping an Individual for Biallelic Markers. The diagnostics may be based on a single biallelic marker or a on group of biallelic markers.

In each of these methods, a nucleic acid sample is obtained from the test subject and the biallelic marker pattern of one or more of the biallelic markers listed in Table 7(A–B) is determined.

In one embodiment, a PCR amplification is conducted on the nucleic acid sample to amplify regions in which polymorphisms associated with a detectable phenotype have been identified. The amplification products are sequenced to determine whether the individual possesses one or more polymorphisms associated with a detectable phenotype. The primers used to generate amplification products may comprise the primers listed in Table 13, or a preferred set of primers includes those described in SEQ ID Nos. 26–70, 72–418, 425–489, 491–530, 532–539, 541–646, and 651–652. Alternatively, the nucleic acid sample is subjected to microsequencing reactions as described above to determine whether the individual possesses one or more polymorphisms associated with a detectable phenotype resulting from a mutation or a polymorphism in a candidate gene. The primers used in the microsequencing reactions may include the primers listed in Table 12, or a preferred set of primers includes those described in SEQ ID Nos. 26–70, 72418, 425–489,491–530, 532–539, 541–646, and 651–652. In another embodiment, the nucleic acid sample is contacted with one or more allele specific oligonucleotide probes which, specifically hybridize to one or more candidate gene alleles associated with a detectable phenotype. The probes used in the hybridization assay may include the probes listed in Table 14, or a preferred set of probes includes those described in SEQ ID Nos. 26–70, 72–418, 425–489, 491–530, 532–539, 541–646, and 651–652.

The present invention provides methods of determining whether an individual is at risk of developing asthma, or whether said individual suffers from asthma, comprising: a) genotyping said individual for at least one 12-LO-related biallelic marker; and b) correlating the result of step a) with a risk of developing asthma. In a preferred embodiment, said 12-LO-related biallelic marker is selected from the group consisting of biallelic markers: 12-197-244, 12-208-35, 12-226-167, 12-206-366, 10-346-141, 10-347-111, 10-347-165, 10-347-203, 10-347-220, 10-349-224, 10-341-116, 12-196-119, 12-214-129, 12-216-421, 12-219-230, and 12-223-207. Preferably, said 12-LO-related biallelic marker is selected from the biallelic markers described in Example 5. The present invention also provides methods of determining whether an individual is at risk of developing hepatoxicity upon treatment with zileuton, comprising: a) genotyping said individual for at least one 12-LO-related biallelic marker; and b) correlating the result of step a) with a risk of developing hepatotoxicity upon treatment with zileuton. In a preferred embodiment, said 12-LO-related biallelic marker is selected from the group consisting of biallelic markers: 12-197-244, 12-208-35, 12-226-167, 12-206-366, 10-346-141, 10-347-111, 10-347-165, 10-347-220, 10-349-97, 10-349-224, 10-341-116, 12-196-119, 12-214-129, 12-216-421, 12-219-230, and 12-223-207. Preferably, said 12-LO-related biallelic marker is selected from the biallelic markers described in Example 5, Association between Side Effects upon Treatment with the Anti-Asthmatic Drug Zileuton (Zyflo™) and the Biallelic Markers of the 12-lipoxygenase Gene.

These diagnostic methods are extremely valuable as they can, in certain circumstances, be used to initiate preventive treatments or to allow an individual carrying a significant haplotype to foresee warning signs such as minor symptoms. In diseases in which attacks may be extremely violent and sometimes fatal if not treated on time, such as asthma, the knowledge of a potential predisposition, even if this predisposition is not absolute, might contribute in a very significant manner to treatment efficacy. Similarly, a diagnosed predisposition to a potential side effect could immediately direct the physician toward a treatment for which such side effects have not been observed during clinical trials.

Diagnostics, which analyze and predict response to a drug or side effects to a drug, may be used to determine whether an individual should be treated with a particular drug. For example, if the diagnostic indicates a likelihood that an individual will respond positively to treatment with a particular drug, the drug may be administered to the individual. Conversely, if the diagnostic indicates that an individual is likely to respond negatively to treatment with a particular drug, an alternative course of treatment may be prescribed. A negative response may be defined as either the absence of an efficacious response or the presence of toxic side effects.

Clinical drug trials represent another application for the markers of the present invention. One or more markers indicative of response to an agent acting on arachidonic acid metabolism or to side effects to an agent acting on arachidonic acid metabolism may be identified using the methods described above. Thereafter, potential participants in clinical trials of such an agent may be screened to identify those individuals most likely to respond favorably to the drug and exclude those likely to experience side effects. In that way, the effectiveness of drug treatment may be measured in individuals who respond positively to the drug, without lowering the measurement as a result of the inclusion of individuals who are unlikely to respond positively in the study and without risking undesirable safety problems.

VI. Computer-Related Embodiments

As used herein the term "nucleic acid codes of the invention" encompass the nucleotide sequences comprising, consisting essentially of, or consisting of any one of the following: a) a contiguous span of at least 12, 15, 18, 20, 25, 30, 35, 40, 50, 60, 70, 80, 90, 100, 150, 200, 500 or 1000 nucleotides, to the extent that a polynucleotide of these lengths is consistent with the lengths of the particular Sequence ID, of a sequence selected from the group consisting of the sequences described in Table 8, and the complements thereof, excluding Sequence ID Nos. 1–10, 19, 23–25, and 647–650; b) a contiguous span of at least 12, 15, 18, 20, 25, 30, 35, 40, 50, 60, 70, 80, 90, 100, 150, 200, 500 or 1000 nucleotides, to the extent that a polynucleotide of these lengths is consistent with the lengths of the particular Sequence ID, of a sequence selected from the group consisting of the sequences described in Table 9, and the complements thereof, excluding Sequence ID Nos. 11–18 and 20–21; c) a contiguous span of at least 12, 15, 18, 20, 25, 30, 35, 40, 50, 60, 70, 80, 90, 100, 150, 200, or 500 nucleotides, to the extent that a polynucleotide of these lengths is consistent with the lengths of the particular Sequence ID, of a sequence selected from the group consisting of the sequences described in Table 12, more preferably a set of markers or sequences consisting of those markers or sequences found in SEQ ID Nos. 26–70, 72–418, 425–489, 491–530, 532–539, 541–646, and 651–652, and the complements thereof, wherein said span includes an eicosanoid-related biallelic marker, preferably an eicosanoid-related biallelic marker described in Table 7(A–B), preferably the biallelic markers found in SEQ ID Nos. 26–70, 72–418, 425–489, 491–530, 532–539, 541–646, and 651–652, or more preferably from SEQ ID Nos. 651–652, 680–724, 726–1072, 1079–1143, 1145–1184, 1186–1193, and 1195–1300, in said sequence with the alternative allele present at said biallelic marker.

The "nucleic acid codes of the invention" further encompass nucleotide sequences homologous to a contiguous span of at least 30, 35, 40, 50, 60, 70, 80, 90, 100, 150, 200, 500 or 1000 nucleotides, to the extent that a contiguous span of these lengths is consistent with the lengths of the particular Sequence ID, of a sequence selected from the group consisting of the sequences described in Tables 8, 9, and 12, and the complements thereof. Homologous sequences refer to a sequence having at least 99%, 98%, 97%, 96%, 95%, 90%, 85%, 80%, or 75% homology to these contiguous spans. Homology may be determined using any method described herein, including BLAST2N with the default parameters or with any modified parameters. Homologous sequences also may include RNA sequences in which uridines replace the thymines in the nucleic acid codes of the invention. It will be appreciated that the nucleic acid codes of the invention can be represented in the traditional single character format (See the inside back cover of Stryer, Lubert. *Biochemistry*, $3^{rd}$ edition. W. H Freeman & Co., New York.) or in any other format or code which records the identity of the nucleotides in a sequence.

It will be appreciated by those skilled in the art that the nucleic acid codes of the invention, one or more of the polypeptide codes of SEQ ID Nos. 653 and 654 can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid codes of the invention and one or more of the polypeptide codes of SEQ ID Nos. 653–654. Another aspect of the present invention is a computer readable medium having recorded thereon at least 2, 5, 10, 15, 20, 25, 30, or 50 nucleic acid codes of the invention, and the complements thereof. Another aspect of the present invention is a computer readable medium having recorded thereon at least 2, 5, 10, 15, 20, 25, 30, or 50 polypeptide codes of SEQ ID Nos. 653–654.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Embodiments of the present invention include systems, particularly computer systems which store and manipulate the sequence information described herein. As used herein, "a computer system" refers to the hardware components, software components, and data storage components used to analyze the nucleotide sequences of the nucleic acid codes of the invention , or the amino acid sequences of the polypeptide codes of SEQ ID Nos. 653–654. In one embodiment, the computer system is a Sun Enterprise 1000 server (Sun Microsystems, Palo Alto, Calif.). The computer system preferably includes a processor for processing, accessing and manipulating the sequence data. The processor can be any well-known type of central processing unit, such as the Pentium III from Intel Corporation, or similar processor from Sun, Motorola, Compaq or International Business Machines. Preferably, the computer system is a general purpose system that comprises the processor and one or more internal data storage components for storing data, and one or more data retrieving devices for retrieving the data stored on the data storage components. A skilled artisan can readily appreciate that any one of the currently available computer systems are suitable. In one particular embodiment, the computer system includes a processor connected to a bus which is connected to a main memory (preferably implemented as RAM) and one or more internal data storage devices, such as a hard drive and/or other computer readable media having data recorded thereon. In some embodiments, the computer system further includes one or more data retrieving device for reading the data stored on the internal data storage devices. The data retrieving device may represent, for example, a floppy disk drive, a compact disk drive, a magnetic tape drive, etc. In some embodiments, the internal data storage device is a removable computer readable medium such as a floppy disk, a compact disk, a magnetic tape, etc. containing control logic and/or data recorded thereon. The computer system may advantageously include or be programmed by appropriate software for reading the control logic and/or the data from the data storage component once inserted in the data retrieving device. The computer system includes a display which is used to display output to a computer user. It should also be noted that the computer system can be linked to other computer systems in a network or wide area network to provide centralized access to the computer system. Software for accessing and processing the nucleotide sequences of the nucleic acid codes of the invention, or the amino acid sequences of the polypeptide codes of SEQ ID Nos. 653–654 (such as search tools, compare tools, and modeling tools etc.) may reside in main memory during execution. In some embodiments, the computer system may further comprise a sequence comparer for comparing the above-described nucleic acid codes of the invention or polypeptide codes of SEQ ID Nos. 653–654 stored on a computer readable medium to reference nucleotide or polypeptide sequences stored on a computer readable medium. A "sequence comparer" refers to one or more programs which are implemented on the computer system to compare a nucleotide or polypeptide sequence with other nucleotide or polypeptide sequences and/or compounds including but not limited to peptides, peptidomimetics, and chemicals stored within the data storage means. For example, the sequence comparer may compare the nucleotide sequences of the nucleic acid codes of the invention, or the amino acid sequences of the polypeptide codes of SEQ ID Nos. 653–654 stored on a computer readable medium to reference sequences stored on a computer readable medium to identify homologies, motifs implicated in biological function, or structural motifs. The various sequence comparer programs identified elsewhere in this patent specification are particularly contemplated for use in this aspect of the invention.

One embodiment is a process for comparing a new nucleotide or protein sequence with a database of sequences in order to determine the homology levels between the new sequence and the sequences in the database. The database of sequences can be a private database stored within the computer system, or a public database such as GENBANK, PIR OR SWISSPROT that is available through the Internet.

The process begins at a start state and then moves to a state wherein the new sequence to be compared is stored to a memory in a computer system. As discussed above, the memory could be any type of memory, including RAM or an internal storage device. The process then moves to a state wherein a database of sequences is opened for analysis and comparison. The process then moves to a state wherein the first sequence stored in the database is read into a memory on the computer. A comparison is then performed at a state to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are id introduced into a sequence during comparison are normally entered by the user of the computer system. Once a comparison of the two sequences has been performed at the state, a determination is made at a decision state whether the two sequences are the same. Of course, the term "same" is not limited to sequences that are absolutely identical. Sequences that are within the homology parameters entered by the user will be marked as "same" in the process. If a determination is made that the two sequences are the same, the process moves to a state wherein the name of the sequence from the database is displayed to the user. This state notifies the user that the sequence with the displayed name fulfills the homology constraints that were entered. Once the name of the stored sequence is displayed to the user, the process moves to a decision state wherein a determination is made whether more sequences exist in the database. If no more sequences exist in the database, then the process terminates at an end state. However, if more sequences do exist in the database, then the process moves to a state wherein a pointer is moved to the next sequence in the database so that it can be compared to the new sequence. In this manner, the new sequence is aligned and compared with every sequence in the database. It should be noted that if a determination had been made at the decision statethat the sequences were not homologous, then the process would move immediately to the decision state in order to determine if any other sequences were available in the database for comparison. Accordingly, one aspect of the present invention is a computer system comprising a processor, a data storage device having stored thereon a nucleic acid code of the invention or a polypeptide code of SEQ ID Nos. 653–654, a data storage device having retrievably stored thereon reference nucleotide sequences or polypeptide sequences to be compared to the nucleic acid code of the invention or polypeptide code of SEQ ID Nos. 653–654 and a sequence comparer for conducting the comparison. The sequence comparer may indicate a homology level between the sequences compared or identify structural motifs in the above described nucleic acid code of the invention and polypeptide codes of SEQ ID Nos. 653–654 or it may identify structural motifs in sequences which are compared to these nucleic acid codes and polypeptide codes. In some embodiments, the data storage device may have stored thereon the sequences of at least 2, 5, 10, 15, 20, 25, 30, or 50 of the nucleic acid codes of the invention or polypeptide codes of SEQ ID Nos. 653–654.

Another aspect of the present invention is a method for determining the level of homology between a nucleic acid code of the invention and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading 2, 5, 10, 15, 20, 25, 30, or 50 of the above described nucleic acid codes of the invention through use of the computer program and determining homology between the nucleic acid codes and reference nucleotide sequences.

One embodiment is a process in a computer for determining whether two sequences are homologous. The process begins at a start state and then moves to a state wherein a first sequence to be compared is stored to a memory. The second sequence to be compared is then stored to a memory at a state. The process then moves to a state wherein the first character in the first sequence is read and then to a state wherein the first character of the second sequence is read. It should be understood that if the sequence is a nucleotide sequence, then the character would normally be either A, T, C, G or U. If the sequence is a protein sequence, then it should be in the single letter amino acid code so that the first and sequence sequences can be easily compared.

A determination is then made at a decision state whether the two characters are the same. If they are the same, then the process moves to a state wherein the next characters in the first and second sequences are read. A determination is then made whether the next characters are the same. If they are, then the process continues this loop until two characters are not the same. If a determination is made that the next two characters are not the same, the process moves to a decision state to determine whether there are any more characters either sequence to read. If there aren't any more characters to read, then the process moves to a state wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%. Alternatively, the computer program may be a computer program which compares the nucleotide sequences of the nucleic acid codes of the present invention, to reference nucleotide sequences in order to determine whether the nucleic acid code of the invention differs from a reference nucleic acid sequence at one or more positions. Optionally such a program records the length and identity of inserted, deleted or substituted nucleotides with respect to the sequence of either the reference polynucleotide or the nucleic acid code of the invention. In one embodiment, the computer program may be a program which determines whether the nucleotide sequences of the nucleic acid codes of the invention contain a biallelic marker or single nucleotide polymorphism (SNP) with respect to a reference nucleotide sequence. This single nucleotide polymorphism may comprise a single base substitution, insertion, or deletion, while this biallelic marker may comprise about one to ten consecutive bases substituted, inserted or deleted.

Another aspect of the present invention is a method for determining the level of homology between a polypeptide code of SEQ ID Nos. 653–654 and a reference polypeptide sequence, comprising the steps of reading the polypeptide code of SEQ ID Nos. 653–654 and the reference polypeptide sequence through use of a computer program which determines homology levels and determining homology between the polypeptide code and the reference polypeptide sequence using the computer program.

Accordingly, another aspect of the present invention is a method for determining whether a nucleic acid code of the invention differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms. The method may be implemented by the computer systems described above. The method may also be performed by reading at least 2, 5, 10, 15, 20, 25, 30, or 50 of the nucleic acid codes of the invention and the reference nucleotide sequences through the use of the computer program and identifying differences between the nucleic acid codes and the reference nucleotide sequences with the computer program. In other embodiments the computer based system may further comprise an identifier for identifying features within the nucleotide sequences of the nucleic acid codes of the invention or the amino acid sequences of the polypeptide codes of SEQ ID Nos. 653–654. An "identifier" refers to one or more programs which identifies certain features within the above-described nucleotide sequences of the nucleic acid codes of the invention or the amino acid sequences of the polypeptide codes of SEQ ID Nos. 653–654. In one embodiment, the identifier may comprise a program which identifies an open reading frame in the cDNAs codes of SEQ ID No. 652.

One embodiment is an identifier process for detecting the presence of a feature in a sequence. The process begins at a start state and then moves to a state wherein a first sequence that is to be checked for features is stored to a memory in the computer system. The process then moves to a state wherein a database of sequence features is opened. Such a database would include a list of each feature's attributes along with the name of the feature. For example, a feature name could be "Initiation Codon" and the attribute would be "ATG." Another example would be the feature name "TAATAA Box" and the feature attribute would be "TAATAA". An example of such a database is produced by the University of Wisconsin Genetics Computer Group (www.gcg.com). Once the database of features is opened at the state, the process moves to a state wherein the first feature is read from the database. A comparison of the attribute of the first feature with the first sequence is then made at a state. A determination is then made at a decision state whether the attribute of the feature was found in the first sequence. If the attribute was found, then the process moves to a state 318 wherein the name of the found feature is displayed to the user. The process then moves to a decision state wherein a determination is made whether move features exist in the database. If no more features do exist, then the process terminates at an end state. However, if more features do exist in the database, then the process reads the next sequence feature at a state and loops back to the state wherein the attribute of the next feature is compared against the first sequence. It should be noted, that if the feature attribute is not found in the first sequence at the decision state, the process moves directly to the decision state in order to determine if any more features exist in the database. In another embodiment, the identifier may comprise a molecular modeling program which determines the 3-dimensional structure of the polypeptides codes of SEQ ID Nos. 653–654. In some embodiments, the molecular modeling program identifies target sequences that are most compatible with profiles representing the structural environments of the residues in known three-dimensional protein structures. (See, e.g., Eisenberg et al., U.S. Pat. No. 5,436,850 issued Jul. 25, 1995, the disclosure of which is incorporated herein by reference in its entirety). In another technique, the known three-dimensional structures of proteins in a given family are superimposed to define the structurally conserved regions in that family. This protein modeling technique also uses the known three-dimensional structure of a homologous protein to approximate the structure of the polypeptide codes of SEQ ID Nos. 653–654. (See e.g., Srinivasan, et al., U.S. Pat. No. 5,557,535 issued Sep. 17, 1996, the disclosure of which is incorporated herein by reference in its entirety). Conventional homology modeling techniques have been used routinely to build models of proteases and antibodies. (Sowdhamini et al., Protein Engineering 10:207, 215 (1997), the disclosure of which is incorporated herein by reference in its entirety). Comparative approaches can also be used to develop three-dimensional protein models when the protein of interest has poor sequence identity to template proteins. In some cases, proteins fold into similar three-dimensional structures despite having very weak sequence identities. For example, the three-dimensional structures of a number of helical cytokines fold in similar three-dimensional topology in spite of weak sequence homology. The recent development of threading methods now enables the identification of likely folding patterns in a number of situations where the structural relatedness between target and template(s) is not detectable at the sequence level. Hybrid methods, in which fold recognition is performed using Multiple Sequence Threading (MST), structural equivalencies are deduced from the threading output using a distance geometry program DRAGON to construct a low resolution model, and a full-atom representation is constructed using a molecular modeling package such as QUANTA.

According to this 3-step approach, candidate templates are first identified by using the novel fold recognition algorithm MST, which is capable of performing simultaneous threading of multiple aligned sequences onto one or more 3-D structures. In a second step, the structural equivalencies obtained from the MST output are converted into interresidue distance restraints and fed into the distance geometry program DRAGON, together with auxiliary information obtained from secondary structure predictions. The program combines the restraints in an unbiased manner and rapidly generates a large number of low resolution model confirmations. In a third step, these low resolution model confirmations are converted into full-atom models and subjected to energy minimization using the molecular modeling package QUANTA. (See e.g., Aszódi et al., Proteins: Structure, Function, and Genetics, Supplement 1:38–42 (1997), the disclosure of which is incorporated herein by reference in its entirety).

The results of the molecular modeling analysis may then be used in rational drug design techniques to identify agents which modulate the activity of the polypeptide codes of SEQ ID Nos. 653–654. Accordingly, another aspect of the present invention is a method of identifying a feature within the nucleic acid codes of the invention or the polypeptide codes of SEQ ID Nos. 653–654 comprising reading the nucleic acid code(s) or the polypeptide code(s) through the use of a computer program which identifies features therein and identifying features within the nucleic acid code(s) or polypeptide code(s) with the computer program. In one embodiment, computer program comprises a computer program which identifies open reading frames. In a further embodiment, the computer program identifies structural motifs in a polypeptide sequence. In another embodiment, the computer program comprises a molecular modeling program. The method may be performed by reading a single sequence or at least 2, 5, 10, 15, 20, 25, 30, or 50 of the nucleic acid codes of the invention or the polypeptide codes of SEQ ID Nos. 653–654 through the use of the computer program and identifying features within the nucleic acid codes or polypeptide codes with the computer program. The nucleic acid codes of the invention or the polypeptide codes of SEQ ID Nos. 653–654 may be stored and manipulated in a variety of data processor programs in a variety of formats. For example, the nucleic acid codes of the invention or the polypeptide codes of SEQ ID Nos. 653–654 may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide or polypeptide sequences to be compared to the nucleic acid codes of the invention or the polypeptide codes of SEQ ID Nos. 653–654. The following list is intended not to limit the invention but to provide guidance to programs and databases which are useful with the nucleic acid codes of the invention or the polypeptide codes of SEQ ID No. 653–654. The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, *J. Mol. Biol.* 215: 403 (1990), the disclosure of which is incorporated herein by reference in its entirety), FASTA (Pearson and Lipman, *Proc. Natl. Acad. Sci. USA*, 85: 2444 (1988), the disclosure of which is incorporated herein by reference in its entirety), FASTDB (Brutlag et al. Comp. App. Biosci. 6:237–245, 1990, the disclosure of which is incorporated herein by reference in its entirety), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the EMBL/Swissprotein database, the MDL Available Chemicals Directory database, the MDL Drug Data Report data base, the Comprehensive Medicinal Chemistry database, Derwents's World Drug Index database, the BioByteMasterFile database, the Genbank database, and the Genseqn database. Many other programs and data bases would be apparent to one of skill in the art given the present disclosure. Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

It should be noted that the nucleic acid codes of the invention further encompass all of the polynucleotides disclosed, described or claimed in the present invention. Also, it should be noted that the polypeptide codes of SEQ ID Nos. 653–654 further encompass all of the polypeptides disclosed, described or claimed in the present invention. Moreover, the present invention specifically contemplates the storage of such codes on computer readable media and computer systems individually or in combination, as well as the use of such codes and combinations in the methods of section "VI. Computer-Related Embodiments."

Throughout this application, various publications, patents, and published patent applications are cited. The disclosures of the publications, patents, and published patent specifications referenced in this application are hereby incorporated by reference into the present disclosure to more fully describe the state of the art to which this invention pertains.

VII. DNA Typing Methods and Systems

The present invention also encompasses a DNA typing system having a much higher discriminatory power than currently available typing systems. The systems and associated methods are particularly applicable in the identification of individuals for forensic science and paternity determinations. These applications have become increasingly important; in forensic science, for example, the identification of individuals by polymorphism analysis has become widely accepted by courts as evidence.

While forensic geneticists have developed many techniques to compare homologous segments of DNA to determine if the segments are identical or if they differ in one or more nucleotides, each technique still has certain disadvantages. In particular, the techniques vary widely in terms of expense of analysis, time required to carry out an analysis and statistical power.

RFLP Analysis Methods

The best known and most widespread method in forensic DNA typing is the restriction fragment length polymorphism (RFLP) analysis. In RFLP testing, a repetitive DNA sequence referred to as a variable number tandem repeat (VNTR) which varies between individuals is analyzed. The core repeat is typically a sequence of about 15 base pairs in length, and highly polymorphic VNTR loci can have an average of about 20 alleles. DNA restriction sites located on either site of the VNTR are exploited to create DNA fragments from about 0.5 Kb to less than 10 Kb which are then separated by electrophoresis, indicating the number of repeats found in the individual at the particular loci. RFLP methods generally consist of (1) extraction and isolation of DNA, (2) restriction endonuclease digestion; (3) separation of DNA fragments by electrophoresis; (4) capillary transfer; (5) hybridization with radiolabelled probes; (6) autoradiography; and (7) interpretation of results (Lee, H. C. et al., Am. J. Forensic. Med. Pathol. 15(4): 269–282 (1994)). RFLP methods generally combine analysis at about 5 loci and have much higher discriminate potential than other available test due the highly polymorphic nature of the VNTRs. However, autoradiography is costly and time consuming and an analysis generally takes weeks or months for turnaround. Additionally, a large amount of sample DNA is required, which is often not available at a crime scene. Furthermore, the reliability of the system and its credibility as evidence is decreased because the analysis of tightly spaced bands on electrophoresis results in a high rate of error.

PCR Methods

PCR based methods offer an alternative to RFLP methods. In a first method called AmpFLP, DNA fragments containing VNTRs are amplified and then separated electrophoretically, without the restriction step of RFLP method. While this method allows small quantities of sample DNA to be used, decreases analysis time by avoiding autoradiography, and retains high discriminatory potential, it nevertheless requires electrophoretic separation which takes substantial time and introduces an significant error rate. In another AmpFLP method, short tandem repeats (STRs) of 2 to 8 base pairs are analyzed. STRs are more suitable to analysis of degraded DNA samples since they require smaller amplified fragments but have the disadvantage of requiring separation of the amplified fragments. While STRs are far less informative than longer repeats, similar discriminatory potential can be achieved if enough STRs are used in a single analysis.

Other methods include sequencing of mitochondrial DNA, which is especially suitable for situations where sample DNA is very degraded or in small quantities. However, only a small region of 1 Kb of the mitochondrial DNA referred to as the D-Loop locus has been found useful for typing because of its polymorphic nature, resulting in lower discriminatory potential than with RFLP or AmpFLP methods. Furthermore, DNA sequencing is expensive to carry out on a large number of samples.

Further available methods include dot-blot methods, which involve using allele specific oligonucleotide probes which hybridize sequence specifically to one allele of a polymorphic site. Systems include the HLA DQ-alpha kit developed by Cetus Corp. which has a discriminatory value of about 1 in 20, and a dot-blot strip referred to as the Polymarker strip combining five genetic loci for a discriminatory value of about one in a few thousand. (Weedn, V., Clinics in Lab. Med. 16(1): 187–196 (1996)).

In addition to difficulties in analysis and time consuming laboratory procedures, it remains desirable for all DNA typing systems to have a higher discriminatory power. Several applications exist in which even the most discriminating tests need improvement in order to remove the considerable remaining doubt resulting from such analyses. Table 3 below lists characteristics of currently available forensic testing systems (Weedn, (1996)) and compares them with the method of the invention.

TABLE 3

| Test type | Technology | Turnaround time | Discriminatory potential | Sensitivity (amount DNA) | Sample |
|---|---|---|---|---|---|
| RFLP | VNTR (autoradiography) | Weeks or months | $10^6$ to $10^9$ | 10 ng | Highly intact DNA |
| AmpFLP | VNTR (PCR based) | Days | $10^3$ to $10^6$ | 100 pg | Moderate degradation |
| Dot blot (ex. HLADQA1) | Sequence specific oligonucleotide probes | Days | $10^1$ to $10^3$ | 1 ng | Moderate degradation |
| Mitochondrial DNA | D-loop sequence (PCR based) | Days | $10^2$ | 1 pg | Severe degradation |
| Present marker set of the invention | Biallelic Markers (set of 13, set of 100, set of 500, set of 650) | Hours to Days (throughput dependent) | $10^6$, $10^{47}$, $10^{650}$ | 100 pg | Moderate degradation |

Applications

As described above, an important application of DNA typing tests is to determine whether a DNA sample (e.g. from a crime scene) originated from an individual suspected of leaving said DNA sample.

There are several applications for DNA typing which require a particularly powerful genotyping system. In a first application, a high powered typing system is advantageous when for example a suspect is identified by searching a DNA profile database such as that maintained by the U.S. Federal Bureau of Investigation. Since databases may contain large numbers of data entries that are expected to increase consistently, currently used forensic systems can be expected to identify several matching DNA profiles due to their relative lack of power. While database searches generally reinforce the evidence by excluding other possible suspects, low powered typing systems resulting in the identification of several individuals may often tend to diminish the overall case against a defendant.

In another application, a target population is systematically tested to identify an individual having the same DNA profile as that of a DNA sample. In such a situation, a defendant is chosen at random based on DNA profile from a large population of innocent individuals. Since the population tested can often be large enough that at least one positive match is identified, and it is usually not possible to exhaustively test a population, the usefulness of the evidence will depend on the level of significance of the forensic test. In order to render such an application useful as a sole or primary source of evidence, DNA typing systems of extremely high discriminatory potential are required.

In yet another application, it is desirable to be able to discriminate between related individuals. Because related individuals will be expected to share a large portion of alleles at polymorphic sites, a very high powered DNA typing assay would be required to discriminate between them. This can have important effects if a sample is found to match the defendant's DNA profile and no evidence that the perpetrator is a relative can be found.

Accordingly, there a need in this art for a rapid, simple, inexpensive and accurate technique having a very high resolution value to determine relationships between individuals and differences in degree of relationships. Also, there is a need in the art for a very accurate genetic relationship test procedure which uses very small amounts of an original DNA sample, yet produces very accurate results.

The present invention thus involves methods for the identification of individuals comprising determining the identity of the nucleotides at set of genetic markers in a biological sample, wherein said set of genetic markers comprises at least one eicosanoid-related biallelic marker. The present invention provides an extensive set of biallelic markers allowing a higher discriminatory potential than the genetic markers used in current forensic typing systems. Also, biallelic markers can be genotyped in individuals with much higher efficiency and accuracy than the genetic markers used in current forensic typing systems. In preferred embodiments, the invention comprises determining the identity of a nucleotide at an eicosanoid-related biallelic marker by single nucleotide primer extension, which does not require electrophoresis as in techniques described above and results in lower rate of experimental error. As shown in Table 3, herein, in comparison with PCR based VNTR based methods which allow discriminatory potential of thousands to millions, and RFLP based methods which allow discriminatory potential of merely millions to billions under optimal assumptions, the biallelic marker based method of the present invention provides a radical increase in discriminatory potential.

Any suitable set of genetic markers and biallelic markers of the invention may be used, and may be selected according to the discriminatory power desired. Biallelic markers, sets of biallelic markers, probes, primers, and methods for determining the identity of said biallelic markers are further described herein.

Discriminatory Potential of Biallelic Marker Typing Calculating Discriminatory Potential The discriminatory potential of the forensic test can be determined in terms of the profile frequency, also referred to as the random match probability, by applying the product rule. The product rule involves multiplying the allelic frequencies of all the individual alleles tested, and multiplying by an additional factor of 2 for each heterozygous locus.

In one example discussed below, the discriminatory potential of biallelic marker typing can be considered in the context of forensic science. In order to determine the discriminatory potential with respect to the numbers of biallelic markers to be used in a genetic typing system, the formulas and calculations below assume that (1) the population under study is sufficiently large (so that we can assume no consanguinity); (2) all markers chosen are not correlated, so that the product rule (Lander and Budlowle (1992)) can be applied; and (3) the ceiling rule can be applied or that the allelic frequencies of markers in the population under study are known with sufficient accuracy.

As noted in Weir, B. S., *Genetic data Analysis II: Methods for Discrete population genetic Data*, Sinauer Assoc., Inc., Sunderland, Mass., USA, 1996, the example assumes a crime has been committed and a sample of DNA from the perpetrator (P) is available for analysis. The genotype of this DNA sample can be determined for several genetic markers, and the profile A of the perpetrator can thereby be determined.

In this example, one suspect (S) is available for typing. The same set of genetic markers, such as the biallelic markers of the invention, are typed and the same profile A is obtained for (S) and (P). Two hypotheses are thus presented as follows:

(1) either S is P (event C)
(2) either S is not P (event $\overline{C}$).

The ratio L of both probabilities can then be calculated using the following equation:

$$L = \frac{pr(S = A, P = A/C)}{pr(S = A, P = A/\overline{C})}$$

L can then further be calculated by the following equation:

$$L = \frac{1}{pr(P = A/S = A, \overline{C})} \quad (1) \qquad \text{Equation 1}$$

These probabilities as well as L can be calculated in several settings, notably for different kinship coefficients between P and S for a genetic marker (see Weir, (1996)).

Assuming that all genetic markers chosen are independent of each other, the global ratio L for a set of genetic markers will be the product over each genetic marker of all L.

It is further possible to estimate the mean number of biallelic markers or VNTRs required to have a ratio L equal to $10^8$ or $10^6$ by calculating the expectancy of the random variable L using the following equation:

$$E(L) = \prod_{i=1}^{N} E(L_i) \text{ where } N \text{ is the number of } loci$$

$$E(L_i) = \sum_{j=1}^{G_i} pr(P = A_{ij}/S = A_{ij}, \overline{C}).$$

$L_{ij}$, where $A_{ij}$ is the genotype $j$ at the ith marker, $L_{ij}$ the ratio associated with such genotype, $G_i$ being the number of genotypes at locus i.

From equation 1, it can easily be derived that the expectancy of $L_i$ is $G_i$, the number of possible genotypes of this marker.

The general expectancy for a set of genetic markers can then be expressed by the following equation:

$$E(L) = \prod_{i=1}^{N} G_i \quad \text{Equation 2}$$

A. Biallelic Marker-based DNA Typing Systems

Using the equations described above, it is possible to select biallelic marker-based DNA typing systems having a desired discriminatory potential.

Using biallelic markers, E(L) can thus be expressed as $3^N$. When using VNTR-based DNA typing systems, assuming the VNTRs have 10 alleles, E(L) can be expressed as $55^N$. Based on these results, the number of biallelic markers or VNTRs needed to obtain, in mean, a ratio of at least $10^6$ or $10^8$ can calculated, and are set forth below in Table 4.

TABLE 4

| Marker sets | L = $10^6$ | L = $10^8$ |
|---|---|---|
| Biallelic | 13 | 17 |
| 5-allele markers (e.g. VNTR) | 5 | 7 |
| 10-allele markers (e.g. VNTR) | 4 | 5 |

Thus, in a first embodiment, DNA typing systems and methods of the invention may comprise genotyping a set of at least 13 or at least 17 biallelic markers to obtain a ratio of at least $10^6$ or $10^8$, assuming a flat distribution of L across the biallelic markers. In preferred embodiments, a greater number of biallelic markers is genotyped to obtain a higher L value. Preferably at least 1, 2, 3, 4, 5, 10, 13, 15, 17, 20, 25, 30, 40, 50, 70, 85, 100, 150, 200, 300, 400, 500, 600 or all of the eicosanoid-related biallelic markers are genotyped. Said DNA typing systems of the invention would result in L values as listed in Table 5 below as an indication of the discriminate potential of the systems of the invention.

TABLE 5

| Number of biallelic markers | L |
|---|---|
| 50 | 7.2 * $10^{22}$ |
| 100 | 5 * $10^{47}$ |
| 650 | $3^{650}$ |

In situations where the distribution of L is not flat, such as in the worst case when the perpetrator is homozygous for the major allele at each genetic locus and L thus takes the lowest value, a larger number of biallelic markers is required for the same discriminatory potential. Therefore, in preferred embodiments, DNA typing systems and methods of the invention using a larger number of biallelic markers allow for uneven distributions of L across the biallelic markers. For example, assuming unrelated individuals, a set of independent markers having an allelic frequency of 0.1/0.9, and the genetic profile of a homozygote at each genetic loci for the major allele, 66 biallelic markers are required to obtain a ratio of $10^6$, and 88 biallelic markers are required to obtain a ratio of $10^8$. Thus, in preferred embodiments based on the use of markers having a major allele of sufficiently high frequency, this is a first estimation of the upper bound of markers required in a DNA typing system.

In further embodiments, it is also desirable to have the ability to discriminate between relatives. Although unrelated individuals have a low probability of sharing genetic profiles, the probability is greatly increased for relatives. For example, the DNA profile of a suspect matches the DNA profile of a sample at a crime scene, and the probability of obtaining the same DNA profile if left by an untyped relative is required. Table 6 below (Weir (1996)) lists probabilities for several different types of relationships, assuming alleles $A_i$ and $A_j$, and population frequencies $P_i$ and $p_j$, and lists likelihood ratios assuming genetic loci having allele frequencies of 0.1.

TABLE 6

| Genotype | Relationship | Pr(p = A\|S = A) | L |
|---|---|---|---|
| $A_i A_j$ | Full brothers | $(1 + p_i + p_j + 2p_ip_j)/4$ | 3.3 |
| | Father and son | $(p_i + p_j)/2$ | 10.0 |
| | Half brothers | $(p_i + p_j + 4p_ip_j)/4$ | 16.7 |
| | Uncle and nephew | $(1 + p_i + p_j + 2p_ip_j)/4$ | 16.7 |
| | First cousins | $(1 + p_i + p_j + 12p_ip_j)/8$ | 25.0 |
| | Unrelated | $2p_ip_j$ | 50.0 |
| $A_j A_j$ | Full brothers | $(1 + p_i)^2/4$ | 3.3 |
| | Father and son | $p_i$ | 10.0 |
| | Half brothers | $p_i(1 + p_i)/2$ | 18.2 |
| | Uncle and nephew | $p_i(1 + p_i)/2$ | 18.2 |
| | First cousins | $p_i(1 + 3p_i)/4$ | 30.8 |
| | Unrelated | $p_i^2$ | 100.0 |

In one example, where the suspect is the full brother of the perpetrator, the number of required biallelic markers will be 187 assuming the profile is that of a homozygote for the major allele at each biallelic marker.

In yet further embodiments, the DNA typing systems and methods of the present invention may further take into account effects of subpopulations on the discriminatory potential. In embodiments described above for example, DNA typing systems consider close familial relationships, but do not take into account membership in the same population. While population membership is expected to have little effect, the invention may further comprise genotyping a larger set of biallelic markers to achieve higher discriminatory potential. Alternatively, a larger set of biallelic markers may be optimized for typing selected populations; alternatively, the ceiling principle may be used to study allele frequencies from individuals in various populations of interest, taking for any particular genotype the maximum allele frequency found among the populations.

The invention thus encompasses methods for genotyping comprising determining the identity of a nucleotide at least 13, 15, 17, 20, 25, 30, 40, 50, 66, 70, 85, 88, 100, 187, 200, 300, 500, 700, 1000 or 2000 biallelic markers in a biological sample, wherein at least 1, 2, 3, 4, 5, 10, 13, 17, 20, 25, 30, 40, 50, 70, 85, 100, 150, 200, 300, 400, 500, 600 or all of said biallelic markers are eicosanoid-related biallelic markers selected from the group consisting of the markers provided in Table 7(A–B).

Any markers known in the art may be used with the eicosanoid-related biallelic markers of the present invention in the DNA typing methods and systems described herein, for example in anyone of the following web sites offering collections of SNPs and information about those SNPs:

The Genetic Annotation Initiative (http://cgap.nci.nih.gov/GAI/). An NIH run site which contains information on candidate SNPs thought to be related to cancer and tumorigenesis generally.

dbSNP Polymorphism Repository (http://www.ncbi.nlm.nih.gov/SNP/). A more comprehensive NIH-run database containing information on SNPs with broad applicability in biomedical research.

HUGO Mutation Database Initiative http://ariel.ucs.unimelb.edu.au:80/~cotton/mdi.htm). A database meant to provide systematic access to information about human mutations including SNPs. This site is maintained by the Human Genome Organization (HUGO).

Human SNP Database (http://www-genome.wi.mit.edu/SNP/human/index.html). Managed by the Whitehead Institute for Biomedical Research Genome Institute, this site contains information about SNPs resulting from the many Whitehead research projects on mapping and sequencing.

SNPs in the Human-Genome SNP database (http://www.ibc.wustl.edu/SNP). This website provides access to SNPs that have been organized by chromosomes and cytogenetic location. The site is run by Washington University.

HGBase http://hgbase.cgr.ki.se/). HGBASE is an attempt to summarize all known sequence variations in the human genome, to facilitate research into how genotypes affect common diseases, drug responses, and other complex phenotypes, and is run by the Karolinska Institute of Sweden.

The SNP Consortium Database (http://snp.cshl.org/db/snp/map). A collection of SNPs and related information resulting from the collaborative effort of a number of large pharmaceutical and information processing companies.

GeneSNPs (http://www.genome.utah.edu/genesnps/). Run by the University of Utah, this site contains information about SNPs resulting from the U.S. National Institute of Environmental Health's initiative to understand the relationship between genetic variation and response to environmental stimuli and xenobiotics.

In addition, biallelic markers provided in the following patents and patent applications may also be used with the eicosanoid-related biallelic markers of the invention in the DNA typing methods and systems described above: U.S. Serial No. 60/206,615, filed 24 Mar. 2000; U.S. Serial No. 60/216,745, filed 30 Jun. 2000; WIPO Serial No. PCT/IB00/00184, filed 11 Feb. 2000; WIPO Serial No. PCT/IB98/01193, filed 17 Jul. 1998; PCT Publication No. WO 99/54500, filed 21 Apr. 1999; and WIPO Serial No. PCT/IB00/00403, filed 24 Mar. 2000.

Biallelic markers, sets of biallelic markers, probes, primers, and methods for determining the identity of a nucleotide at said biallelic markers are also encompassed and are further described herein, and may encompass any further limitation described in this disclosure, alone or in any combination.

Forensic matching by microsequencing is further described in Example 8 below.

EXAMPLES

Several of the methods of the present invention are described in the following examples, which are offered by way of illustration and not by way of limitation. Many other modifications and variations of the invention as herein set forth can be made without departing from the spirit and scope thereof and therefore only such limitations should be imposed as are indicated by the appended claims.

Example 1
De Novo Identification of Biallelic Markers

The biallelic markers set forth in this application were isolated from human genomic sequences. To identify biallelic markers, genomic fragments were amplified, sequenced and compared in a plurality of individuals.

DNA Samples

Donors were unrelated and healthy. They represented a sufficient diversity for being representative of a French heterogeneous population. The DNA from 100 individuals was extracted and tested for the de novo identification of biallelic markers.

DNA samples were prepared from peripheral venous blood as follows. Thirty ml of peripheral venous blood were taken from each donor in the presence of EDTA. Cells (pellet) were collected after centrifugation for 10 minutes at 2000 rpm. Red cells were lysed in a lysis solution (50 ml final volume: 10 mM Tris pH7.6; 5 mM $MgCl_2$; 10 mM NaCl). The solution was centrifuged (10 minutes, 2000 rpm) as many times as necessary to eliminate the residual red cells present in the supernatant, after resuspension of the pellet in the lysis solution. The pellet of white cells was lysed overnight at 42° C. with 3.7 ml of lysis solution composed of: (a) 3 ml TE 10–2 (Tris-HCl 10 mM, EDTA 2 mM)/NaCl 0.4 M; (b) 200 $\mu$l SDS 10%; and (c) 500 $\mu$l proteinase K (2 mg proteinase K in TE 10–2/NaCl 0.4 M).

For the extraction of proteins, 1 ml saturated NaCl (6M) (1/3.5 v/v) was added. After vigorous agitation, the solution was centrifuged for 20 minutes at 10000 rpm. For the precipitation of DNA, 2 to 3 volumes of 100% ethanol were added to the previous supernatant, and the solution was centrifuged for 30 minutes at 2000 rpm. The DNA solution was rinsed three times with 70% ethanol to eliminate salts, and centrifuged for 20 minutes at 2000 rpm. The pellet was dried at 37° C., and resuspended in 1 ml TE 10–1 or 1 ml water. The DNA concentration was evaluated by measuring the OD at 260 nm (1 unit OD=50 $\mu$g/ml DNA). To determine the presence of proteins in the DNA solution, the OD 260/OD 280 ratio was determined. Only DNA preparations having a OD 260/OD 280 ratio between 1.8 and 2 were used in the subsequent examples described below. DNA pools were constituted by mixing equivalent quantities of DNA from each individual.

Amplification of Genomic DNA by PCR

Amplification of specific genomic sequences was carried out on pooled DNA samples obtained as described above.

Amplification Primers

The primers used for the amplification of human genomic DNA fragments were defined with the OSP software (Hillier & Green, 1991). Preferably, primers included, upstream of the specific bases targeted for amplification, a common oligonucleotide tail useful for sequencing. Primers PU contain the following additional PU 5' sequence: TGTAAAAC-GACGGCCAGT; primers RP contain the following RP 5' sequence: CAGGAAACAGCTATGACC. Primers are listed in Table 13.

_Amplification_

PCR assays were performed using the following protocol:

| | |
|---|---|
| Final volume | 25 $\mu$l |
| DNA | 2 ng/$\mu$l |
| $MgCl_2$ | 2 mM |
| dNTP (each) | 200 $\mu$M |
| primer (each) | 2.9 ng/$\mu$l |

-continued

Amplification

PCR assays were performed using the following protocol:

| | |
|---|---|
| Ampli Taq Gold DNA polymerase | 0.05 unit/µl |
| PCR buffer (10x = 0.1 M TrisHCl pH 8.3 0.5M KCl) | 1x |

DNA amplification was performed on a Genius II thermocycler. After heating at 94° C. for 10 min, 40 cycles were performed. Cycling times and temperatures were: 30 sec at 94° C., 55° C. for 1 min and 30 sec at 72° C. Holding for 7 min at 72° C. allowed final elongation. The quantities of the amplification products obtained were determined on 96-well microtiter plates, using a fluorometer and Picogreen as intercalant agent (Molecular Probes).

Sequencing of Amplified Genomic DNA and Identification of Biallelic Polymorphisms Sequencing of the amplified DNA was carried out on ABI 377 sequencers. The sequences of the amplification products were determined using automated dideoxy terminator sequencing reactions with a dye terminator cycle sequencing protocol. The products of the sequencing reactions were run on sequencing gels and the sequences were determined using gel image analysis (ABI Prism DNA Sequencing Analysis software 2.1.2 version).

The sequence data were further evaluated to detect the presence of biallelic markers within the amplified fragments. The polymorphism search was based on the presence of superimposed peaks in the electrophoresis pattern resulting from different bases occurring at the same position. However, the presence of two peaks can be an artifact due to background noise. To exclude such an artifact, the two DNA strands were sequenced and a comparison between the two strands was carried out. In order to be registered as a polymorphic sequence, the polymorphism had to be detected on both strands. Further, some biallelic single nucleotide polymorphisms were confirmed by microsequencing as described below.

Figure 3:
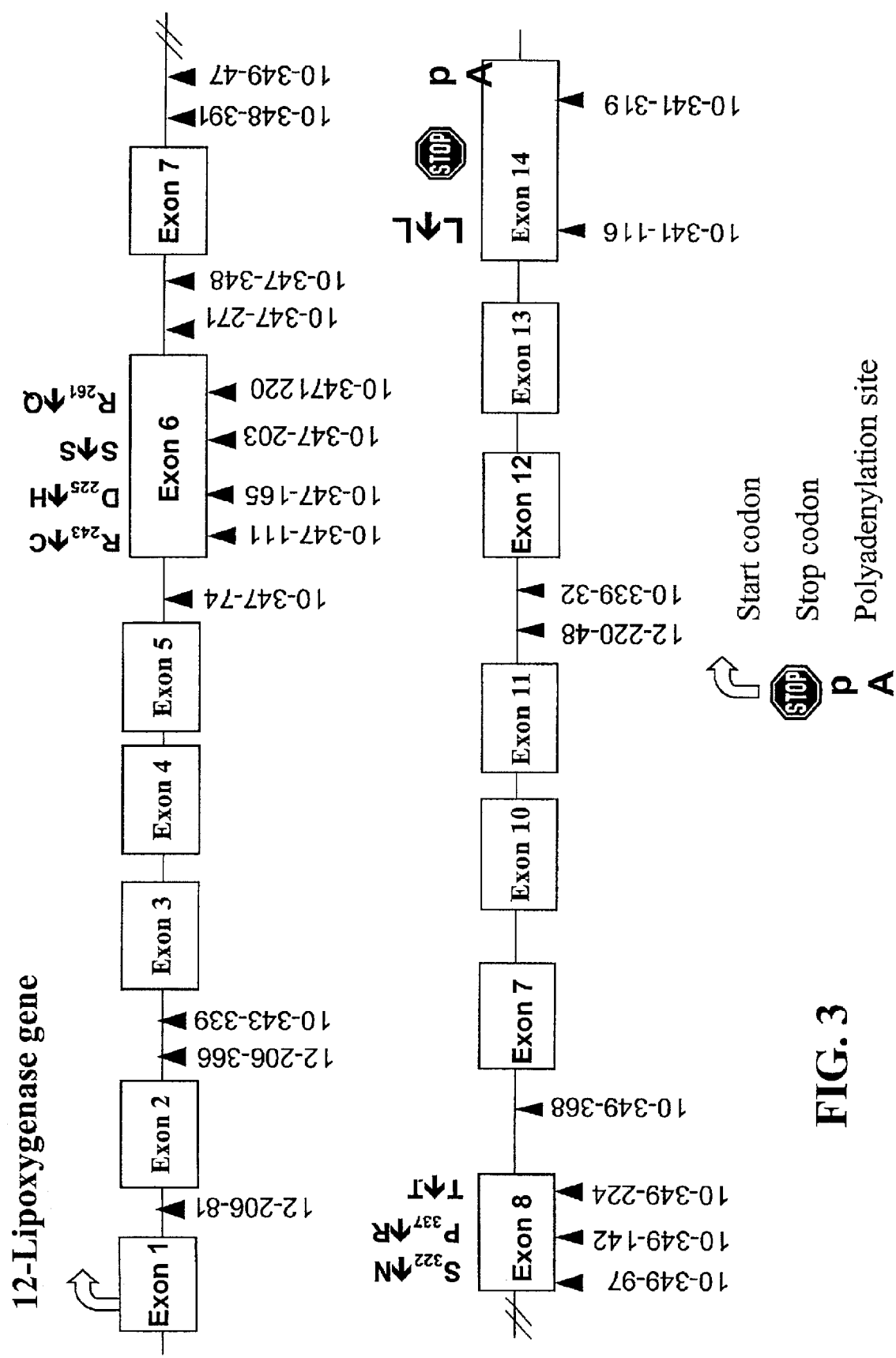
FIG. 3 is a diagram showing the genomic structure of the 12-lipoxygenase gene and the positions of biallelic markers in close proximity of this gene.

Biallelic markers were identified in the analyzed fragments and are shown in Table 7. Also, the genomic structure of the FLAP gene and 12-LO gene including the relative location of some biallelic markers is shown in FIG. 1 and FIG. 3, respectively.

Example 2

Genotyping of Biallelic Markers

The biallelic markers identified as described above were further confirmed and their respective frequencies were determined through microsequencing. Microsequencing was carried out on individual DNA samples obtained as described herein.

Microsequencing Primers

Amplification of genomic DNA fragments from individual DNA samples was performed as described in Example 1 using the same set of PCR primers. Microsequencing was carried out on the amplified fragments using specific primers. See Table 12. The preferred primers used in microsequencing had about 19 nucleotides in length and hybridized just upstream of the considered polymorphic base.

The microsequencing reactions were performed as follows: 5 µl of PCR products were added to 5 µl purification mix (2U SAP (Shrimp alkaline phosphate) (Amersham E70092X)); 2U Exonuclease I (Amersham E70073Z); and 1 µl SAP buffer (200 MM Tris-HCl pH8, 100 mM $MgCl_2$) in a microtiter plate. The reaction mixture was incubated 30 minutes at 37° C., and denatured 10 minutes at 94° C. afterwards. To each well was then added 20 µl of microsequencing reaction mixture containing: 10 pmol microsequencing oligonucleotide (19 mers, GENSET, crude synthesis, 5 OD), 1 U Thermosequenase (Amersham E79000G), 1.25 µl Thermosequenase buffer (260 mM Tris HCl pH 9.5, 65 mM $MgCl_2$), and the two appropriate fluorescent ddNTPs complementary to the nucleotides at the polymorphic site corresponding to both polymorphic bases (11.25 nM TAMRA-ddTTP; 16.25 nM ROX-ddCTP; 1.675 nM REG-ddATP; 1.25 nM RHO-ddGTP ; Perkin Elmer, Dye Terminator Set 401095). After 4 minutes at 94° C., 20 PCR cycles of 15 sec at 55° C., 5 see at 72° C., and 10 sec at 94° C. were carried out in a Tetrad PTC-225 thermocycler (MJ Research). The microtiter plate was centrifuged 10 sec at 1500 rpm. The unincorporated dye terminators were removed by precipitation with 19 µl $MgCl_2$ 2 mM and 55 µl 100% ethanol. After 15 minute incubation at room temperature, the microtiter plate was centrifuged at 3300 rpm 15 minutes at 4° C. After discarding the supernatants, the microplate was evaporated to dryness under reduced pressure (Speed Vac). Samples were resuspended in 2.5 µl formamide EDTA loading buffer and heated for 2 min at 95° C. 0.8 µl microsequencing reaction were loaded on a 10% (19:1) polyacrylamide sequencing gel. The data were collected by an ABI PRISM 377 DNA sequencer and processed using the GENESCAN software (Perkin Elmer).

Frequency of Biallelic Markers

Frequencies are reported for the less common allele only and are shown in Table 7.

Example 3

Association Study between Asthma and the Biallelic Markers of the FLAP Gene

Collection of DNA Samples from Case and Control Individuals

The disease trait followed in this association study was asthma, a disease involving the leukotriene pathway. The asthmatic population corresponded to 298 individuals that took part in a clinical study for the evaluation of the anti-asthmatic drug Zileuton. More than 90% of these 298 asthmatic individuals had a Caucasian ethnic background. The control population was composed of 286 individuals from a random US Caucasian population.

Genotyping of Case and Control Individuals

The general strategy to perform the association studies was to individually scan the DNA samples from all individuals in each of the populations described above in order to establish the allele frequencies of the above described biallelic markers in each of these populations.

Allelic frequencies of the above-described biallelic marker alleles in each population were determined by performing microsequencing reactions on amplified fragments obtained by genomic PCR performed on the DNA samples from each individual. Genomic PCR and microsequencing were performed as detailed above in Examples 1 and 2 using the described PCR and microsequencing primers.

Figure 2:
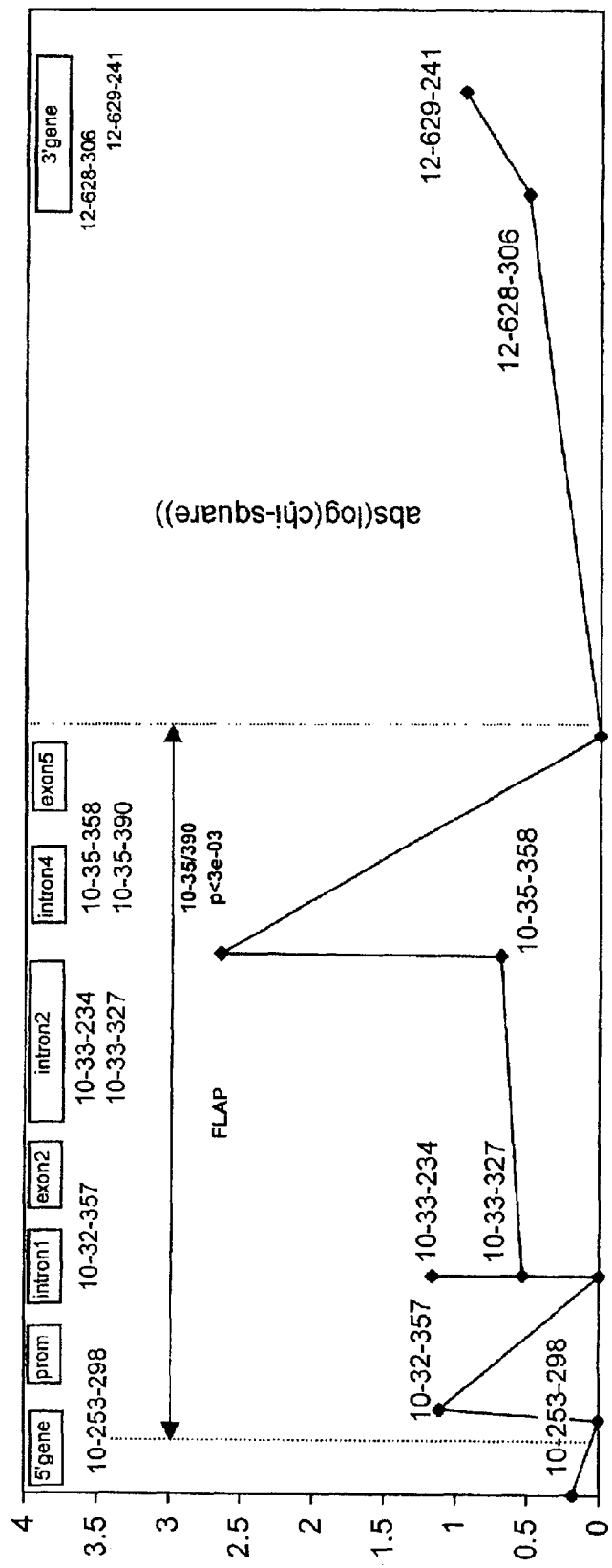
FIG. 2 is a graph showing the results of the single point association study between biallelic markers from the FLAP gene and asthma.

Frequency of the Biallelic Marker Alleles of the FLAP Gene and Association with Asthma Frequencies of biallelic marker alleles were compared in the case-control populations described above. The association curve in FIG. 2 shows the p-value obtained for each marker and the localization of the markers in the genomic region harboring the FLAP gene. As shown in FIG. 2, the biallelic marker 10-35-390 presented a strong association with asthma, this association being highly significant (pvalue=$2.29 \times 10^{-3}$). The two markers 10-32-357 and 10-33-234 show association when tested independently. The biallelic marker 10-35/390 is located in the FLAP gene. Therefore, the association studies results show that a polymorphism of the FLAP gene seems to be related to asthma. The biallelic marker 10-35-390 can be then used in diagnostics with a test based on this marker or on a combination of biallelic markers comprising this marker.

Haplotype Frequency Analysis

The results of the haplotype analysis using 9 biallelic markers (10-253-298, 10-32-357, 10-33-175, 10-33-234, 10-33-327, 10-35-358, 10-35-390, 12-628-306, and 12-629-241) are shown in Table 15. Haplotype analysis for association of FLAP markers and asthma was performed by estimating the frequencies of all possible 2, 3 and 4 marker haplotypes in the asthmatic and Caucasian US control populations. Haplotype estimations were performed by applying the Expectation-Maximization (EM) algorithm (Excoffier and Slatkin, 1995), using the EM-HAPLO program (Hawley et al., 1994). Estimated haplotype frequencies in the asthmatic and control populations were compared by means of a chi-square statistical test.

The most significant haplotypes obtained are shown in Table 15.

Preferred haplotypes comprise either the marker 10-33-234 (allele A) or the marker 10-35-390 (allele T). Preferred haplotype No. 1 (A at 10-33-234 and T at 10-35-390) presented a p-value of $8.2 \times 10^{-4}$ and an odd-ratio of 1.61. Estimated haplotype frequencies were 28.3% in the cases and 19.7% in the US controls. Also preferred are haplotypes No. 2 (A at 10-33-234 and G at 12-629-241) and haplotype No. 3 (T at 10-33/327 and T at 10-33/390) which presented respectively a p-value of $1.6 \times 10^{-3}$ and $1.8 \times 10^{-3}$, an odd-ratio of 1.65 and 1.53 and haplotypes frequencies of 0.305 and 0.307 for the asthmatic population and of 0.210 and 0.224 for the US control population.

Preferred haplotypes consisting of three markers (haplotype nos. 37, 38, 39 and 41) comprise the marker 10-33-234 (allele A) and the marker 10-35-390 (allele T). Preferred haplotype No. 37 (A at 10-33-234, T at 10-33-390 and C at 12-628-306) presented a p-value of $8.6 \times 10^{-4}$ and an odd-ratio of 1.76. Estimated haplotype frequencies were 26.5% in the cases and 17.1% in the US controls. Haplotype No. 40 (A at 10-33-234, C at 12-628-306 and G at 12-629-241) is also very significantly associated with asthma.

Four-marker haplotypes (haplotype Nos. 121 to 125), five-marker haplotypes (haplotype Nos. 247 and 248) and a six-marker haplotype (haplotype No. 373) also showed significant p-values. They all comprise markers 10-33-234 (allele A) and 10-35/390 (allele T), except haplotype no. 124. Other markers in these haplotypes are chosen from the group consisting of 10-235-298 (allele C), 10-35-358 (allele G), 12-628-306 (allele C) and 12-629-241 (allele G).

Haplotype No. 1 is the preferred haplotype of the invention. It can be used in diagnosis of asthma. Moreover, most of the haplotypes significantly associated with asthma comprise the biallelic marker 10-35-390 (allele A) and could also be used in diagnosis.

The statistical significance of the results obtained for the haplotype analysis was evaluated by a phenotypic permutation test reiterated 1000 or 10,000 times on a computer. For this computer simulation, data from the asthmatic and control individuals were pooled and randomly allocated to two groups which contained the same number of individuals as the case-control populations used to produce the data summarized in Table 15. A haplotype analysis was then run on these artificial groups for the 2 markers included in the haplotype No. 1, which showed the strongest association with asthma. This experiment was reiterated 1000 and 10,000 times and the results are shown in Table 16. These results demonstrate that among 1000 iterations none and among 10,000 iterations only 1 of the obtained haplotypes had a p-value comparable to the one obtained for the haplotype No. 1. These results clearly validate the statistical significance of the association between this haplotype and asthma.

Example 4

Association between Asthma and the Biallelic Markers of the 12-lipoxygenase Gene Collection of DNA Samples from Case and Control Individuals The disease trait followed in this association study was asthma, a disease involving the leukotriene pathway. The asthmatic population corresponded to 297 individuals that took part in a clinical study for the evaluation of the anti-asthmatic drug zileuton. More than 90% of these 297 asthmatic individuals had a Caucasian ethnic background. The control population corresponded to 186 individuals from a random US Caucasian population.

Genotyping of Case and Control Individuals

The general strategy to perform the association studies was to individually scan the DNA samples from all individuals in each of the populations described above in order to establish the allele frequencies of the above described biallelic markers in each of these populations.

Allelic frequencies of the above-described biallelic marker alleles in each population were determined by performing microsequencing reactions on amplified fragments obtained by genomic PCR performed on the DNA samples from each individual. Genomic PCR and microsequencing were performed as detailed above in Examples 1 and 2 using the described PCR and microsequencing primers.

Haplotype Frequency Analysis

None of the single marker alleles showed a significant association with asthma however, significant results were obtained in haplotype studies. Allelic frequencies were useful to check that the markers used in the haplotype studies meet the Hardy-Weinberg proportions (random mating).

Haplotype analysis was performed using 12 biallelic markers and 17 biallelic markers. The results of the haplotype analysis using 12 biallelic markers (12-208-35, 12-226-167, 12-206-366, 10-347-203, 10-347-220, 10-349-97, 10-349-224, 12-196-119, 12-214-129, 12-216-421, 12-219-230 and 12-223-207) are shown in Table 17. The results of the haplotype analysis using 17 biallelic markers (12-197-244, 12-208-35, 12-226-167, 12-206-366, 10-346-141, 10-347-165, 10-347-203, 10-347-220, 10-349-97, 10-349-224, 10-341-116, 12-196-119, 12-214-129, 12-216-421 and 12-219-230) are shown in Table 18. Haplotype analysis for association of 12-LO biallelic markers and asthma was performed by estimating the frequencies of all possible 2, 3 and 4 marker haplotypes in the asthmatic and control populations described above. Haplotype estimations were performed by applying the Expectation-Maximization (EM) algorithm (Excoffier and Slatkin, *Mol. Biol. Evol.*, 12:921–927, 1995), using the EM-HAPLO program (Hawley et al., *Am. J. Phys. Anthropol.*, 18:104, 1994) as described above. Estimated haplotype frequencies in the asthmatic and control population were compared by means of a chi-square statistical test (one degree of freedom).

Table 17 shows the most significant haplotypes obtained from the 12 biallelic marker analysis. Haplotype No. 1 consisting of three biallelic markers (10-347-220, 12-214-129 and 12-219-230) presented a p-value of $2.10^{-5}$ and an odd-ratio of 3.38. Estimated haplotype frequencies were 12.3% in the cases and 4% in the controls. Haplotype No.14 consisting of four biallelic markers (10-347-203, 12-196-119, 12-216-421 and 12-219-230) had a p-value of $4.10^{-6}$ and an odd ratio of 4.18. Estimated haplotype frequencies were 11.8% in the cases and 3.1% in the controls. Haplotype No.1 and haplotype No.14, are both strongly associated with asthma. Haplotypes Nos. 2–13 and 15–24 also showed very significant Association (see Table 17).

Table 18 shows the most significant haplotypes obtained from the 17 biallelic marker analysis. Haplotype No. 1 consisting of two biallelic markers (12-206-366 and 10-349-224) presented a p-value of 1.8 $10^{-4}$ and an odd-ratio of 2.05. Estimated haplotype frequencies were 42.4% in the cases and 26.5% in the controls. Haplotype No. 7 consisting of three biallelic markers (10-349-97, 12-214-129, 12-219-230) had a p-value of 2.3 $10^{-5}$ and an odd ratio of 3.32. Estimated haplotype frequencies were 12.5% in the cases and 4.1% in the controls. Haplotype No. 27 consisting of four biallelic markers (10-349-97, 12-196-119, 12-216-421 and 12-219-230) had a p-value of 5.4 $10^{-6}$ and an odd ratio of 3.90. Estimated haplotype frequencies were 12.4% in the cases and 3.5% in the controls. Haplotypes Nos. 1, 7 and 27 are strongly associated with asthma. Other haplotypes also showed very significant association (see Table 18).

The statistical significance of the results obtained for the haplotype analysis was evaluated by a phenotypic permutation test reiterated 1000 or 10,000 times on a computer. For this computer simulation, data from the asthmatic and control individuals were pooled and randomly allocated to two groups which contained the same number of individuals as the case-control populations used to produce the data summarized in Tables 17 and 18. A haplotype analysis was then run on these artificial groups for the markers included in haplotype No. 14 from Table 17 and for the markers included in haplotypes Nos. 7 and 27 from Table 18, which showed the strongest association with asthma. This experiment was reiterated 1000 and 10,000 times and the results are shown in Table 21 and Table 22, respectively. These results demonstrate that among 1000 iterations only 7 and among 10,000 iterations only 39 of the obtained haplotypes from the 12 biallelic marker set had a p-value comparable to the one obtained for haplotype No.14 from Table 17. Also, among 1000 iterations only 2 of the obtained haplotypes from the 17 biallelic marker set had a p-value comparable to the one obtained for haplotype No. 7 from Table 18. These results further demonstrate that among 1000 iterations none of the obtained haplotypes had a p-value comparable to the one obtained for haplotype No. 27 from Table 18. These results clearly validate the statistical significance of the association between the haplotypes shown in Tables 17 and 18 and asthma.

Example 5

Association between Side Effects upon Treatment with the Anti-Asthmatic Drug Zileuton (Zyflo™) and the Biallelic Markers of the 12-lipoxygenase Gene Collection of DNA Samples from Case and Control Individuals The side effect examined in this study was the hepatotoxicity experienced by asthmatic individuals as a result of their treatment with Zileuton as part of a clinical study. Asthmatic individuals were unrelated and more than 90% of the individuals had a Caucasian ethnic background. Hepatotoxicity was monitored by measuring the serum levels of alanine aminotransferase (ALT), which is a sensitive indicator of liver cell damage.

More than 90% of the asthmatic individuals participating in this study did not experience Zileuton-associated ALT increase compared to their ALT levels prior to zileuton intake. As mentioned above, an association study is more informative if the case-control populations present extreme phenotypes. Therefore, the asthmatic individuals, which were selected for the side effect positive trait (ALT+), corresponded to 89 individuals that presented at least 3 times the upper limit of normal (ULN) level of ALT. On the other side, the asthmatic individuals that were selected for the side effect negative trait (ALT−) corresponded to 208 individuals that presented less than 1×ULN of ALT. ALT+ and ALT− populations corresponded to 4% and 35% respectively of the total asthmatic individuals that participated in this study.

Genotyping of Case and Control Individuals

The general strategy to perform the association studies was to individually scan the DNA samples from all individuals in each of the populations described above in order to establish the allele frequencies of the above described biallelic markers in each of these populations.

Allelic frequencies of the above-described biallelic marker alleles in each population were determined by performing microsequencing reactions on amplified fragments obtained by genomic PCR performed on the DNA samples from each individual. Genomic PCR and microsequencing were performed as detailed above in Examples 1 and 2 using the described PCR and microsequencing primers.

Haplotype Frequency Analysis

None of the single marker alleles showed a significant association with hepatoxicity to zileuton, however, significant results were obtained in haplotype studies.

Haplotype analysis was performed using 12 biallelic markers and 17 biallelic markers. The results of the haplotype analysis using 12 biallelic markers (12-208-35, 12-226-167, 12-206-366, 10-347-203, 10-347-220, 10-349-97, 10-349-224, 12-196-119, 12-214-129, 12-216-421, 12-219-230 and 12-223-207) are shown in Table 19. The results of the haplotype analysis using 17 biallelic markers (12-197-244, 12-208-35, 12-226-167, 12-206-366, 10-346-141, 10-347-165, 10-347-203, 10-347-220, 10-349-97, 10-349-224, 10-341-116, 12-196-119, 12-214-129, 12-216-421 and 12-219-230) are shown in Table 20. Haplotype analysis for association of 12-LO biallelic markers and asthma was performed by estimating the frequencies of all possible 2, 3, 4 and 5 marker haplotypes in the ALT+ and ALT− populations described above. Haplotype estimations were performed by applying the Expectation-Maximization (EM) algorithm (Excoffier and Slatkin, *Mol. Biol. Evol.*, 12:921–927, 1995), using the EM-HAPLO program (Hawley et al., *Am. J. Phys. Anthropol.*, 18:104, 1994) as described above. Estimated haplotype frequencies in the ALT+ and ALT− populations were compared by means of a chi-square statistical test (one degree of freedom).

Table 19 shows the most significant haplotypes obtained from the 12 biallelic marker analysis. Haplotype No.3 consisting of three biallelic markers (10-349-224, 12-216-421 and 12-223-207) presented a p-value of $4.10^{-5}$ and an odd-ratio of 3.53. Estimated haplotype frequencies were 15.1% in the cases and 4.8% in the controls. Haplotype No. 8 consisting of four biallelic markers (12-206-366, 10-349-224, 12-216-421 and 12-223-207) had a p-value of $2.9.10^{-6}$ and an odd ratio of 4.56. Estimated haplotype frequencies were 15.8% in the cases and 4% in the controls. Both haplotypes showed strong association with elevated serum ALT level upon treatment with zileuton. Both haplotypes are related as three out of four biallelic marker alleles (T at 10-349-224, A at 12-216-421 and T at 12-223-207) are common to both haplotypes. Haplotypes Nos. 4–7 and 9–25 also showed very significant association.

Table 20 shows the most significant haplotypes obtained from the 17 biallelic marker analysis. Haplotype No. 11 consisting of three biallelic markers (12-197/244, 10-349-224 and 12-216-421) presented a p-value of $1.7.10^{-3}$ and an odd-ratio of 2.66, for alleles CTA respectively. Estimated haplotype frequencies were 13.7% in the cases and 5.6% in the controls. The p-value obtained by a chi-square distribution with 7 df for this combination of markers is $2.310^{-2}$ by Omnibus test suggesting that result is highly significant. Another haplotype consisting of four biallelic markers (12-208-35, 10-512/36,12-196-119 and 12-219/230) presented a p-value of $3.7.10^{-5}$ and an odd-ratio of 3.74. Estimated haplotype frequencies were 14.7% in the cases and 4.4% in the controls. The p-value obtained by a chi-square distribution with 15 df for this combination of markers is $5.410^{-4}$ by Omnibus test. Both haplotypes showed strong association with elevated serum ALT level upon treatment with zileuton. Both haplotypes are related as three out of four biallelic marker alleles (C at 12-197/244, T at 10-349-224 and A at 12-216-421) are common to both haplotypes. Other haplotypes also showed very significant association.

The statistical significance of the results obtained for the haplotype analysis was evaluated by a phenotypic permutation test reiterated 100, 1000 or 10,000 times on a computer. For this computer simulation, data from the ALT+ and ALT− populations were pooled and randomly allocated to two groups which contained the same number of individuals as the ALT+ and ALT− populations used to produce the data summarized in Tables 19 and 20. A haplotype analysis was then run on the artificial groups for the 4 markers included in haplotype No. 8 from Table 17 and on the artificial groups for the 4 markers included in haplotype No. 13 from Table 18, which showed the strongest association with secondary effects to zileuton. This experiment was reiterated 1000 and 10,000 times and the results are shown in Table 21 and Table 22, respectively. These results demonstrate that among 1000 iterations only 5 and among 10,000 iterations only 77 of the obtained haplotypes from the 12 biallelic markers had a p-value comparable to the one obtained for haplotype No. 8. These results demonstrate that among 100 iterations only 3 of the obtained haplotypes from the 17 biallelic markers had a p-value comparable to the one obtained for haplotype No. 11. The p-value obtained by permutating affected status for the omnibus LR test is $2.2.10^{-2}$. These results clearly validate the statistical significance of the association between hepatotoxicity to Zyflo™ and the haplotypes Nos. 3–25 and Nos. 6–30 shown in Table 19 and Table 20, respectively.

Allele Frequency Analysis

Allele frequencies were determined in a random US caucasian population, in an asthmatic population showing no side effects upon treatment with Zyflo™ (ALT−) and in an asthmatic population showing elevated alanine aminotransferase levels upon treatment with Zyflo™ (ALT+). Table 23 is a chart containing a list of preferred 12-LO-related biallelic markers with an indication of the frequency of the least common allele determined by genotyping as described in Example 2.

Example 6
Identification of Mutations and of Low Frequency Alleles of the 12-LO Gene Exons 6, 8 and 14 of the 12-lipoxygenase gene were screened for mutations by comparing their sequence in individuals exhibiting elevated ALT levels upon treatment with zileuton (ALT+) and in individuals showing normal ALT levels upon treatment with zileuton (ALT−). ALT+ and ALT− individuals are further described in Example 5. Intron sequences immediately flanking these exons were also screened.

To identify mutations, fragments of the 12-LO gene were amplified, sequenced and compared in ALT+ and ALT− individuals. DNA samples from each individual were processed separately.

DNA Samples

Individual DNA samples were obtained as described in Example 1.

Amplification of the 12-LO Gene

Amplification primers are described in Table 13. PCR assays were performed as described in Example 1.

Sequencing of Amplified Genomic DNA: Identification of Mutations and of Low Frequency Polymorphisms Sequencing of the amplified DNA was carried out on ABI 377 sequencers. The sequences of the amplification products were determined using automated dideoxy terminator sequencing reactions with a dye terminator cycle sequencing protocol. The products of the sequencing reactions were run on sequencing gels and the sequences were determined using gel image analysis (ABI Prism DNA Sequencing Analysis software 2.1.2 version).

The sequence data was further analyzed to detect the presence of mutations and of low frequency alleles. The sequences of exon 6, exon 8, exon 14 and flanking intronic sequences in 79 ALT+ individuals and 105 ALT− individuals were compared. New polymorphisms/mutations were detected and the genotype of each individual for these markers was determined. Results are shown below:

| Marker ID | Position in 12-LO Gene | Least Common Allele/Mutation | Original Allele |
| --- | --- | --- | --- |
| 10-508-191 | 5' flanking region | C | T |
| 10-508-245 | 5' flanking region | T | C |
| 10-511-62 | 5' flanking region | T | C |
| 10-511-337 | 5' flanking region | Insertion T | — |
| 10-512-36 | 5' flanking region | C | G |
| 10-512-318 | 5' flanking region | A | G |
| 10-513-250 | 5' flanking region | A | G |
| 10-513-262 | 5' flanking region | T | C |
| 10-513-352 | 5' flanking region | A | G |
| 10-513-365 | 5' flanking region | A | G |
| 10-343-231 | Exon 2 | Deletion C | — |
| 10-343-366 | Intron 2 | C | T |
| 10-343-278 | Intron 2 | T | C |
| 10-343-339 | Intron 4 | T | G |
| 10-346-23 | Intron 4 | G | A |
| 10-346-141 | Exon 5 | A | G |
| 10-346-263 | Intron 5 | G | C |
| 10-346-305 | Intron 5 | C | T |
| 10-347-74 | Intron 5 | A | G |
| 10-347-111 | Exon 6 | G | C |
| 10-347-165 | Exon 6 | T | C |
| 10-347-203 | Exon 6 | G | A |
| 10-347-220 | Exon 6 | A | G |
| 10-347-271 | Intron 6 | T | A |
| 10-347-348 | Intron 6 | A | G |
| 10-348-391 | Intron 7 | A | G |
| 10-349-47 | Intron 7 | C | T |
| 10-349-97 | Exon 8 | G | A |
| 10-349-142 | Exon 8 | G | C |
| 10-349-216 | Exon 8 | Deletion CTG | — |
| 10-349-224 | Exon 8 | T | G |
| 10-349-368 | Intron 8 | C | T |
| 10-350-72 | Intron 8 | T | C |
| 10-350-332 | Intron 9 | C | T |
| 10-507-170 | Exon 11 | G | A |
| 10-507-321 | Intron 11 | A | C |
| 10-507-353 | Intron 11 | T | C |
| 10-507-364 | Intron 11 | T | C |
| 10-507-405 | Intron 11 | T | C |
| 10-339-32 | Intron 11 | T | C |
| 10-339-124 | Intron 11 | T | C |
| 10-340-112 | Exon 13 | A | C |

-continued

| Marker ID | Position in 12-LO Gene | Least Common Allele/Mutation | Original Allele |
|---|---|---|---|
| 10-340-130 | Exon 13 | A | T |
| 10-340-238 | Intron 13 | A | G |
| 10-341-116 | Exon 14 | A | G |
| 10-341-319 | Exon 14 (5'UTR) | T | C |
| 10-342-301 | 3' flanking region | Insertion A | — |
| 10-342-373 | 3' flanking region | T | C |

Low frequency polymorphisms and mutations identified in exons 5, 6, 8, and 13 are associated with amino acid substitutions at the polypeptide level. In each of these amino acid substitutions the original residue is replaced by a non-equivalent amino acid presenting different chemical properties. As a consequence, specificity, activity and function of the 12-LO enzyme are modified. Biallelic marker 10-343-231 is associated with a frame shift in the open reading frame of the 12-LO gene leading to the expression of a variant 12-LO polypeptide comprising only 131 amino acids. This mutant 12-LO enzyme is probably inactive or shows differences in specificity, activity and function. Biallelic marker 10-343-231 is associated with the deletion of a Leu residue in the 12-LO polypeptide.

The mutations and low frequency polymorphisms listed above represent potential functional mutations of the 12-LO gene.

Example 7
Preparation of Antibody Compositions to 12-Lipoxygenase Variants

Preferably antibody compositions, specifically binding the 189-His variant of the 12-LO protein or, to the 225-His variant of the 12-LO protein or, to the 243-Cys variant of the 12-LO protein or, to the 261-Arg variant of the 12-LO protein or, to the 322-Asn variant of the 12-LO or, to the 337-Arg variant of the 12-LO protein or to the 574-Lys variant of 12-LO, are prepared. Other preferred antibody compositions of the invention are capable of specifically binding to amino acid positions 110–131 of SEQ ID No. 654.

Substantially pure protein or polypeptide is isolated from transfected or transformed cells containing an expression vector encoding the 12-LO protein or a portion thereof. The concentration of protein in the final preparation is adjusted, for example, by concentration on an Amicon filter device, to the level of a few micrograms per ml. Monoclonal or polyclonal antibodies to the protein can then be prepared as follows:

Monoclonal Antibody Production by Hybridoma Fusion

Monoclonal antibody to epitopes in the 12-LO protein or a portion thereof can be prepared from murine hybridomas according to the classical method of Kohler and Milstein (Nature, 256:495, 1975, the disclosure of which is incorporated herein by reference in its entirety) or derivative methods thereof (see Harlow and Lane, Antibodies A Laboratory Manual, Cold Spring Harbor Laboratory, pp. 53–242, 1988, the disclosure of which is incorporated herein by reference in its entirety).

Briefly, a mouse is repetitively inoculated with a few micrograms of the 12-LO protein or a portion thereof over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, E., Meth. Enzymol. 70:419 (1980), , the disclosure of which is incorporated herein by reference in its entirety, and derivative methods thereof. Selected positive clones can be expanded and their monoclonal antibody product harvested for use. Detailed procedures for monoclonal antibody production are described in Davis, L. et al. Basic Methods in Molecular Biology Elsevier, N.Y. Section 21–2, the disclosure of which is incorporated herein by reference in its entirety.

Polyclonal Antibody Production by Immunization

Polyclonal antiserum containing antibodies to heterogeneous epitopes in the 12-LO protein or a portion thereof can be prepared by immunizing suitable non-human animal with the 12-LO protein or a portion thereof, which can be unmodified or modified to enhance immunogenicity. A suitable non-human animal is preferably a non-human mammal is selected, usually a mouse, rat, rabbit, goat, or horse. Alternatively, a crude preparation which, has been enriched for 12-LO concentration can be used to generate antibodies. Such proteins, fragments or preparations are introduced into the non-human mammal in the presence of an appropriate adjuvant (e.g. aluminum hydroxide, RIBI, etc.) which is known in the art. In addition the protein, fragment or preparation can be pretreated with an agent which will increase antigenicity, such agents are known in the art and include, for example, methylated bovine serum albumin (mBSA), bovine serum albumin (BSA), Hepatitis B surface antigen, and keyhole limpet hemocyanin (KLH). Serum from the immunized animal is collected, treated and tested according to known procedures. If the serum contains polyclonal antibodies to undesired epitopes, the polyclonal antibodies can be purified by immunoaffinity chromatography.

Effective polyclonal antibody production is affected by many factors related both to the antigen and the host species. Also, host animals vary in response to site of inoculations and dose, with both inadequate or excessive doses of antigen resulting in low titer antisera. Small doses (ng level) of antigen administered at multiple intradermal sites appears to be most reliable. Techniques for producing and processing polyclonal antisera are known in the art, see for example, Mayer and Walker (1987), the disclosure of which is incorporated herein by reference in its entirety. An effective immunization protocol for rabbits can be found in Vaitukaitis, J. et al. J. Clin. Endocrinol. Metab. 33:988–991 (1971), the disclosure of which is incorporated herein by reference in its entirety. Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, O. et al., Chap. 19 in: Handbook of Experimental Immunology D. Wier (ed) Blackwell (1973), the disclosure of which is incorporated herein by reference in its entirety. Plateau concentration of antibody is usually in the range of 0.1 to 0.2 mg/ml of serum (about 12 $\mu$M). Affinity of the antisera for the antigen is determined by preparing competitive binding curves, as described, for example, by Fisher, D., Chap. 42 in: Manual of Clinical Immunology, 2d Ed. (Rose and Friedman, Eds.) Amer. Soc. For Microbiol., Washington, D.C. (1980), the disclosure of which is incorporated herein by reference in its entirety.

Antibody preparations prepared according to either the monoclonal or the polyclonal protocol are useful in quantitative immunoassays which determine concentrations of antigen-bearing substances in biological samples; they are also used semi-quantitatively or qualitatively to identify the presence of antigen in a biological sample. The antibodies may also be used in therapeutic compositions for killing cells expressing the protein or reducing the levels of the protein in the body.

Example 8

Forensic Matching by Microsequencing

DNA samples are isolated from forensic specimens of, for example, hair, semen, blood or skin cells by conventional methods. A panel of PCR primers based on a number of the sequences of of the invention is then utilized according to the methods described herein to amplify DNA of approximately 500 bases in length from the forensic specimen. The alleles present at each of the selected biallelic markers site according to biallelic markers of the invention are then identified according Examples discussed herein. A simple database comparison of the analysis results determines the differences, if any, between the sequences from a subject individual or from a database and those from the forensic sample. In a preferred method, statistically significant differences between the suspect's DNA sequences and those from the sample conclusively prove a lack of identity. This lack of identity can be proven, for example, with only one sequence. Identity, on the other hand, should be demonstrated with a large number of sequences, all matching. Preferably, a minimum of 13, 17, 20, 25, 30, 40, 50, 66, 70, 85, 88, 100, 187, 200 or 500 biallelic markers are used to test identity between the suspect and the sample.

The disclosures of all issued patents, published PCT applications, scientific references or other publications cited herein are incorporated herein by reference in their entireties.

Although this invention has been described in terms of certain preferred embodiments, other embodiments which will be apparent to those of ordinary skill in the art of view of the disclosure herein are also within the scope of this invention. Accordingly, the scope of the invention is intended to be defined only by reference to the appended claims.

In accordance with the regulations relating to Sequence Listings, the following codes have been used in the Sequence Listing to indicate the locations of biallelic markers within the sequences and to identify each of the alleles present at the polymorphic base. The code "r" in the sequences indicates that one allele of the polymorphic base is a guanine, while the other allele is an adenine. The code "y" in the sequences indicates that one allele of the polymorphic base is a thymine, while the other allele is a cytosine. The code "m" in the sequences indicates that one allele of the polymorphic base is an adenine, while the other allele is a cytosine. The code "k" in the sequences indicates that one allele of the polymorphic base is a guanine, while the other allele is a thymine. The code "s" in the sequences indicates that one allele of the polymorphic base is a guanine, while the other allele is a cytosine. The code "w" in the sequences indicates that one allele of the polymorphic base is an adenine, while the other allele is a thymine.

In some instances, the polymorphic bases of the biallelic markers alter the identity of amino acids in the encoded polypeptide. This is indicated in the accompanying Sequence Listing by use of the feature VARIANT, placement of a Xaa at the position of the polymorphic amino acid, and definition of Xaa as the two alternative amino acids. For example, if one allele of a biallelic marker is the codon CAC, which encodes histidine, while the other allele of the biallelic marker is CAA, which encodes glutamine, the Sequence Listing for the encoded polypeptide will contain an Xaa at the location of the polymorphic amino acid. In this instance, Xaa would be defined as being histidine or glutamine.

In other instances, Xaa may indicate an amino acid whose identity is unknown because of nucleotide sequence ambiguity. In this instance, the feature UNSURE is used, Xaa is placed at the position of the unknown amino acid, and Xaa is defined as being any of the 20 amino acids or a limited number of amino acids suggested by the genetic code.

TABLE 7A

List of all of the eicosanoid-related biallelic markers.

| GENE | BIALLELIC MARKER ID | SEQ ID NO. | BIALLELIC MARKER POSITION IN SEQ ID NO. | VALIDATION MICRO- SEQUENCING | GENOTYPING LEAST COMMON ALLELE | FREQUENCY % |
|---|---|---|---|---|---|---|
| FLAP | 10-253-118 | 1 | 478 | N | | |
| FLAP | 10-253-298 | 2 | 478 | Y | G | 4.57 |
| FLAP | 10-253-315 | 3 | 478 | N | | |
| FLAP | 10-499-155 | 4 | 478 | N | | |
| FLAP | 10-520-256 | 5 | 478 | N | T | 40.8 |
| FLAP | 10-500-258 | 6 | 478 | N | | |
| FLAP | 10-500-410 | 7 | 478 | N | | |
| FLAP | 10-503-159 | 8 | 478 | N | | |
| FLAP | 10-504-172 | 9 | 478 | N | | |
| FLAP | 10-504-243 | 10 | 478 | N | | |
| FLAP | 10-204-326 | 11 | 478 | Y | A | 6.63 |
| FLAP | 10-32-357 | 12 | 478 | Y | A | 33.5 |
| FLAP | 10-33-175 | 13 | 478 | Y | T | 2.30 |
| FLAP | 10-33-211 | 14 | 478 | N | | |
| FLAP | 10-33-234 | 15 | 478 | Y | A | 44.0 |
| FLAP | 10-33-270 | 16 | 478 | Y | G/G | |
| FLAP | 10-33-327 | 17 | 478 | Y | C | 24.5 |
| FLAP | 10-34-290 | 18 | 478 | N | | |
| FLAP | 10-35-358 | 19 | 478 | Y | C | 31.3 |
| FLAP | 10-35-390 | 20 | 478 | Y | T | 23.0 |

TABLE 7A-continued

List of all of the eicosanoid-related biallelic markers.

| GENE | BIALLELIC MARKER ID | SEQ ID NO. | BIALLELIC MARKER POSITION IN SEQ ID NO. | VALIDATION MICRO-SEQUENCING | GENOTYPING | LEAST COMMON ALLELE FREQUENCY % |
|---|---|---|---|---|---|---|
| FLAP | 10-36-164 | 21 | 478 | Y | G/G | |
| FLAP | 10-498-192 | 22 | 478 | N | | |
| FLAP | 12-628-306 | 23 | 478 | Y | T | 10.3 |
| FLAP | 12-628-311 | 24 | 478 | N | | |
| FLAP | 12-629-241 | 25 | 478 | Y | C | 28.3 |
| 12-LO | 12-206-366 | 26 | 478 | Y | C | 38.2 |
| 12-LO | 10-343-339 | 27 | 478 | N | | |
| 12-LO | 10-347-74 | 28 | 478 | N | | |
| 12-LO | 10-347-111 | 29 | 478 | N | G/G | |
| 12-LO | 10-347-165 | 30 | 478 | N | C/C | |
| 12-LO | 10-347-203 | 31 | 478 | Y | G | 41.6 |
| 12-LO | 10-347-220 | 32 | 478 | Y | A | 40.5 |
| 12-LO | 10-347-271 | 33 | 478 | N | | |
| 12-LO | 10-347-348 | 34 | 478 | N | | |
| 12-LO | 10-348-391 | 35 | 478 | N | | |
| 12-LO | 10-349-47 | 36 | 478 | N | | |
| 12-LO | 10-349-97 | 37 | 478 | Y | G | 39.6 |
| 12-LO | 10-349-142 | 38 | 478 | N | C/C | |
| 12-LO | 10-349-224 | 39 | 478 | Y | T | 39.6 |
| 12-LO | 10-349-368 | 40 | 478 | N | | |
| 12-LO | 10-339-32 | 41 | 478 | N | | |
| 12-LO | 10-341-116 | 42 | 478 | Y | A | 10.8 |
| 12-LO | 10-341-319 | 43 | 478 | N | | |
| 12-LO | 12-196-119 | 44 | 119 | Y | C | 29.1 |
| 12-LO | 12-197-244 | 45 | 243 | Y | C | 32.8 |
| 12-LO | 12-198-128 | 46 | 128 | N | | |
| 12-LO | 12-206-81 | 47 | 478 | N | | |
| 12-LO | 12-208-35 | 48 | 35 | Y | A | 42.3 |
| 12-LO | 12-214-129 | 49 | 129 | Y | C | 38.7 |
| 12-LO | 12-214-151 | 50 | 151 | N | | |
| 12-LO | 12-214-360 | 51 | 358 | N | | |
| 12-LO | 12-215-467 | 52 | 466 | N | | |
| 12-LO | 12-216-421 | 53 | 418 | Y | A | 36.0 |
| 12-LO | 12-219-230 | 54 | 229 | Y | G | 32.1 |
| 12-LO | 12-219-256 | 55 | 255 | N | | |
| 12-LO | 12-220-48 | 56 | 478 | N | | |
| 12-LO | 12-221-302 | 57 | 302 | N | | |
| 12-LO | 12-223-179 | 58 | 179 | N | | |
| 12-LO | 12-223-207 | 59 | 207 | Y | C | 38.4 |
| 12-LO | 12-225-541 | 60 | 540 | Y | C | 37.4 |
| 12-LO | 12-226-167 | 61 | 166 | Y | G | 41.2 |
| 12-LO | 12-226-458 | 62 | 455 | N | | |
| 12-LO | 12-229-332 | 63 | 332 | N | | |
| 12-LO | 12-229-351 | 64 | 351 | N | | |
| 12-LO | 12-230-364 | 65 | 364 | N | | |
| 12-LO | 12-231-100 | 66 | 99 | N | | |
| 12-LO | 12-231-148 | 67 | 147 | N | | |
| 12-LO | 12-231-266 | 68 | 265 | N | | |
| cPLA$_2$ | 10-231-23 | 69 | 500 | Y | A | 8.79 |
| cPLA$_2$ | 10-233-386 | 70 | 501 | Y | G | 28.3 |
| cPLA$_2$ | 10-239-368 | 72 | 501 | N | | |
| cPLA$_2$ | 10-223-30 | 73 | 501 | Y | G | 22.5 |
| cPLA$_2$ | 10-223-72 | 74 | 501 | N | | |
| cPLA$_2$ | 10-223-130 | 75 | 501 | N | | |
| cPLA$_2$ | 10-223-262 | 76 | 501 | N | | |
| cPLA$_2$ | 10-223-392 | 77 | 501 | N | | |
| cPLA$_2$ | 10-224-341 | 78 | 501 | N | | |
| cPLA$_2$ | 10-227-282 | 79 | 501 | Y | G | 3.93 |
| ANX1 | 10-240-241 | 80 | 501 | N | | |
| ANX1 | 10-249-185 | 81 | 501 | N | | |
| ANX1 | 10-251-128 | 82 | 501 | N | | |
| ANX1 | 10-252-209 | 83 | 501 | N | | |
| ANX1 | 12-387-32 | 84 | 501 | Y | G | 33.9 |
| ANX1 | 10-242-316 | 85 | 500 | N | | |
| ANX1 | 10-245-412 | 86 | 501 | N | | |
| ANX1 | 12-378-171 | 87 | 501 | N | | |
| ANX1 | 12-378-228 | 88 | 501 | N | | |
| ANX1 | 12-378-450 | 89 | 501 | N | | |
| ANX1 | 12-379-65 | 90 | 501 | N | | |
| ANX1 | 12-382-204 | 91 | 501 | Y | G | 50.0 |
| ANX1 | 12-383-117 | 92 | 501 | N | | |
| ANX1 | 12-383-170 | 93 | 501 | N | | |

TABLE 7A-continued

List of all of the eicosanoid-related biallelic markers.

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| ANX1 | 12-383-268 | 94 | 501 | N | | |
| ANX1 | 12-384-336 | 95 | 501 | N | | |
| ANX1 | 12-384-451 | 96 | 501 | N | | |
| ANX1 | 12-385-123 | 97 | 258 | N | | |
| ANX1 | 12-385-427 | 98 | 501 | N | | |
| ANX1 | 12-386-155 | 99 | 443 | Y | G | 8.15 |
| ANX1 | 12-386-24 | 100 | 313 | N | | |
| ANX1 | 12-387-177 | 101 | 501 | Y | T | 33.5 |
| ANX1 | 12-389-431 | 102 | 501 | N | | |
| ANX1 | 12-391-366 | 103 | 501 | N | | |
| ANX1 | 12-394-85 | 104 | 501 | N | | |
| ANX1 | 12-395-382 | 105 | 385 | N | | |
| ANX1 | 12-400-217 | 106 | 501 | Y | G | 27.2 |
| ANX1 | 12-400-280 | 107 | 501 | N | | |
| ANX1 | 12-401-378 | 108 | 380 | N | | |
| ANX1 | 12-402-126 | 109 | 323 | N | | |
| ANX1 | 12-404-265 | 110 | 317 | N | | |
| ANX1 | 12-406-52 | 111 | 501 | N | | |
| ANX1 | 12-406-409 | 112 | 501 | N | | |
| ANX1 | 12-407-217 | 113 | 501 | N | | |
| ANX1 | 12-407-399 | 114 | 501 | N | | |
| ANX1 | 12-408-355 | 115 | 501 | Y | G | 2.69 |
| ANX1 | 12-409-221 | 116 | 229 | N | | |
| ANX1 | 12-410-301 | 117 | 486 | N | | |
| ANX2 | 10-395-101 | 118 | 501 | N | | |
| ANX2 | 10-395-124 | 119 | 501 | N | | |
| ANX2 | 10-395-155 | 120 | 501 | N | | |
| ANX2 | 10-395-294 | 121 | 501 | N | | |
| ANX2 | 10-396-100 | 122 | 501 | N | | |
| ANX2 | 10-397-201 | 123 | 501 | N | | |
| ANX2 | 10-399-178 | 124 | 501 | N | | |
| ANX2 | 10-400-369 | 125 | 501 | N | | |
| ANX2 | 10-392-20 | 126 | 497 | N | | |
| ANX2 | 10-392-103 | 127 | 501 | N | | |
| ANX2 | 10-392-324 | 128 | 501 | N | | |
| ANX2 | 10-393-27 | 129 | 501 | N | | |
| ANX2 | 10-393-324 | 130 | 501 | N | | |
| ANX2 | 12-727-237 | 131 | 501 | N | | |
| ANX2 | 12-728-224 | 132 | 501 | N | | |
| ANX2 | 12-730-142 | 133 | 501 | N | | |
| ANX2 | 12-730-193 | 134 | 501 | N | | |
| ANX2 | 12-731-60 | 135 | 501 | N | | |
| ANX2 | 12-731-119 | 136 | 501 | N | | |
| ANX2 | 12-731-137 | 137 | 501 | N | | |
| ANX2 | 12-731-146 | 138 | 501 | N | | |
| ANX2 | 12-731-398 | 139 | 501 | N | | |
| ANX2 | 12-732-113 | 140 | 501 | N | | |
| ANX2 | 12-732-164 | 141 | 501 | N | | |
| ANX2 | 12-732-165 | 142 | 501 | Y | C | 27.4 |
| ANX2 | 12-732-445 | 143 | 501 | N | | |
| ANX2 | 12-734-201 | 144 | 501 | N | | |
| ANX2 | 12-735-42 | 145 | 501 | N | | |
| ANX2 | 12-736-363 | 146 | 501 | N | | |
| ANX2 | 12-737-69 | 147 | 501 | Y | A | 36.8 |
| ANX2 | 12-737-296 | 148 | 501 | N | | |
| ANX2 | 12-738-429 | 149 | 501 | Y | T | 35.5 |
| ANX2 | 12-740-112 | 150 | 501 | Y | G | 37.6 |
| ANX2 | 12-740-118 | 151 | 501 | N | | |
| ANX2 | 12-741-265 | 152 | 501 | N | | |
| ANX2 | 12-741-327 | 153 | 501 | N | | |
| ANX2 | 12-741-376 | 154 | 501 | N | | |
| ANX2 | 12-745-30 | 155 | 501 | N | | |
| ANX2 | 12-745-75 | 156 | 501 | N | | |
| ANX2 | 12-745-343 | 157 | 501 | N | | |
| ANX2 | 12-745-350 | 158 | 501 | N | | |
| ANX2 | 12-746-320 | 159 | 501 | N | | |
| ANX2 | 12-747-181 | 160 | 501 | N | | |
| ANX2 | 12-747-302 | 161 | 501 | N | | |
| ANX2 | 12-749-240 | 162 | 501 | N | | |
| ANX2 | 12-749-255 | 163 | 501 | N | | |
| ANX2 | 12-752-37 | 164 | 508 | N | | |
| ANX2 | 12-752-85 | 165 | 501 | N | | |

TABLE 7A-continued

List of all of the eicosanoid-related biallelic markers.

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| ANX2 | 12-752-196 | 166 | 501 | N | | |
| ANX2 | 12-752-484 | 167 | 501 | N | | |
| ANX2 | 12-753-139 | 168 | 501 | N | | |
| ANX2 | 12-753-376 | 169 | 501 | N | | |
| ANX2 | 12-754-172 | 170 | 501 | N | | |
| ANX2 | 12-754-218 | 171 | 501 | N | | |
| ANX2 | 12-754-328 | 172 | 501 | N | | |
| ANX2 | 12-754-396 | 173 | 501 | N | | |
| ANX2 | 12-755-280 | 174 | 501 | N | | |
| ANX2 | 12-757-384 | 175 | 501 | N | | |
| ANX2 | 12-758-257 | 176 | 501 | N | | |
| ANX2 | 12-758-374 | 177 | 501 | N | | |
| ANX2 | 12-758-424 | 178 | 501 | N | | |
| ANX2 | 12-761-23 | 179 | 541 | N | | |
| ANX2 | 12-761-178 | 180 | 501 | N | | |
| ANX2 | 12-764-329 | 181 | 501 | N | | |
| ANX2 | 12-764-377 | 182 | 501 | N | | |
| ANX2 | 12-765-168 | 183 | 501 | N | | |
| ANX2 | 12-765-504 | 184 | 501 | N | | |
| ANX3 | 10-372-279 | 185 | 501 | N | | |
| ANX3 | 10-375-136 | 186 | 501 | N | | |
| ANX3 | 10-376-281 | 187 | 501 | N | | |
| ANX3 | 10-369-392 | 188 | 501 | N | | |
| ANX3 | 10-371-257 | 189 | 501 | N | | |
| ANX3 | 12-513-389 | 190 | 501 | N | | |
| ANX3 | 12-513-494 | 191 | 501 | N | | |
| ANX3 | 12-515-394 | 192 | 501 | N | | |
| ANX3 | 12-516-97 | 193 | 501 | Y | T | 37.2 |
| ANX3 | 12-520-287 | 194 | 501 | N | | |
| ANX3 | 12-520-323 | 195 | 501 | Y | A | 21.5 |
| ANX3 | 12-523-179 | 196 | 501 | Y | A | 29.9 |
| ANX3 | 12-523-270 | 197 | 501 | N | | |
| ANX3 | 12-527-367 | 198 | 501 | Y | T | 18.9 |
| ANX3 | 12-529-376 | 199 | 501 | N | | |
| ANX3 | 12-529-489 | 200 | 501 | N | | |
| ANX3 | 12-530-134 | 201 | 501 | Y | T | 39.3 |
| ANX3 | 12-530-393 | 202 | 501 | N | | |
| ANX3 | 12-531-173 | 203 | 501 | Y | C | 37.6 |
| ANX3 | 12-539-441 | 204 | 501 | N | | |
| ANX3 | 12-543-78 | 205 | 501 | N | | |
| ANX3 | 12-543-79 | 206 | 501 | N | | |
| ANX3 | 12-546-235 | 207 | 501 | N | | |
| ANX3 | 12-549-287 | 208 | 501 | N | | |
| ANX3 | 12-550-287 | 209 | 501 | N | | |
| ANX3 | 12-552-175 | 210 | 501 | N | | |
| ANX3 | 12-554-330 | 211 | 501 | N | | |
| ANX3 | 12-556-312 | 212 | 501 | N | | |
| ANX3 | 12-556-443 | 213 | 501 | N | | |
| ANX3 | 12-558-205 | 214 | 501 | N | | |
| ANX3 | 12-558-238 | 215 | 501 | N | | |
| ANX3 | 12-558-305 | 216 | 501 | N | | |
| ANX3 | 12-769-39 | 217 | 501 | N | | |
| ANX3 | 12-769-430 | 218 | 501 | N | | |
| ANX3 | 12-770-73 | 219 | 501 | N | | |
| ANX3 | 12-772-200 | 220 | 501 | N | | |
| ANX3 | 12-772-254 | 221 | 501 | N | | |
| CAL1 | 10-87-73 | 222 | 72 | N | | |
| CAL1 | 10-87-74 | 223 | 73 | N | | |
| CAL1 | 10-87-80 | 224 | 79 | N | | |
| CAL1 | 10-87-140 | 225 | 138 | N | | |
| CAL1 | 10-88-81 | 226 | 81 | Y | C | 44.7 |
| CAL1 | 10-89-41 | 227 | 41 | N | | |
| CAL1 | 10-90-35 | 228 | 35 | Y | A | 1.14 |
| CAL1 | 10-91-274 | 229 | 274 | N | | |
| CAL1 | 10-93-133 | 230 | 133 | N | | |
| CAL1 | 10-94-197 | 231 | 197 | Y | G/G | |
| CAL1 | 10-94-198 | 232 | 198 | N | | |
| CAL1 | 10-166-362 | 233 | 362 | N | | |
| CAL2 | 10-207-386 | 234 | 387 | Y | C/C | |
| CAL2 | 10-207-409 | 235 | 409 | Y | G | 9.04 |
| CAL2 | 10-118-307 | 236 | 307 | Y | A | 0.27 |
| CAL2 | 10-173-247 | 237 | 247 | N | | |

TABLE 7A-continued

List of all of the eicosanoid-related biallelic markers.

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| CAL2 | 10-173-294 | 238 | 294 | Y | G | 2.87 |
| CAL2 | 10-173-347 | 239 | 347 | Y | C/C | |
| CAL3 | 10-103-104 | 240 | 104 | N | | |
| CAL3 | 10-103-323 | 241 | 323 | Y | T | 22.3 |
| CAL3 | 10-103-402 | 242 | 403 | N | | |
| CAL3 | 10-106-98 | 243 | 98 | N | | |
| CAL3 | 10-106-288 | 244 | 288 | Y | | |
| CAL3 | 10-106-378 | 245 | 380 | Y | | |
| CAL3 | 10-168-160 | 246 | 160 | Y | T | 42.1 |
| CAL3 | 10-168-206 | 247 | 206 | Y | | |
| CAL3 | 10-168-284 | 248 | 283 | N | | |
| CAL3 | 10-169-318 | 249 | 317 | N | | |
| CALPA1 | 12-86-79 | 250 | 501 | Y | C | 37.4 |
| CALPA1 | 12-88-393 | 251 | 501 | N | | |
| CALPA1 | 12-89-369 | 252 | 501 | Y | G | 36.3 |
| CALPA1 | 12-89-91 | 253 | 501 | N | | |
| CALPA1 | 12-94-210 | 254 | 501 | N | | |
| CALPA1 | 12-94-516 | 255 | 521 | N | | |
| CALPA1 | 12-96-64 | 256 | 501 | Y | T | 8.52 |
| CALPA1 | 12-97-83 | 257 | 501 | N | | |
| CALPA1 | 12-99-296 | 258 | 501 | Y | T | 6.45 |
| CALPA1 | 12-100-266 | 259 | 501 | Y | G | 32.2 |
| CALPA1 | 12-811-174 | 260 | 501 | N | | |
| CALPA1 | 12-815-94 | 261 | 501 | N | | |
| CALPA1 | 12-815-383 | 262 | 501 | N | | |
| CALPA1 | 12-815-384 | 263 | 500 | N | | |
| CALPA1 | 12-815-391 | 264 | 501 | N | | |
| CALPA1 | 12-817-214 | 265 | 501 | N | | |
| CALPA1 | 12-817-355 | 266 | 501 | N | | |
| CALPA1 | 12-819-437 | 267 | 501 | N | | |
| CALPA1 | 12-821-62 | 268 | 501 | N | | |
| CALPA1 | 12-821-483 | 269 | 501 | N | | |
| CALPA1 | 12-825-173 | 270 | 501 | N | | |
| CALPA1 | 12-826-312 | 271 | 501 | N | | |
| CALPA1 | 12-831-59 | 272 | 501 | N | | |
| CALPA1 | 12-833-264 | 273 | 501 | N | | |
| CALPA1 | 12-833-279 | 274 | 501 | N | | |
| CALPA1 | 12-833-280 | 275 | 502 | N | | |
| CALPA1 | 12-833-373 | 276 | 501 | N | | |
| CALPA1 | 12-834-183 | 277 | 483 | N | | |
| CALPA1 | 12-835-54 | 278 | 501 | N | | |
| CALPA1 | 12-836-134 | 279 | 501 | N | | |
| CALPA1 | 12-836-237 | 280 | 500 | N | | |
| CALPA1 | 12-836-238 | 281 | 476 | N | | |
| CALPA1 | 12-836-257 | 282 | 498 | N | | |
| CALPA1 | 12-836-275 | 283 | 501 | N | | |
| CALPA1 | 12-838-179 | 284 | 501 | N | | |
| CALPA1 | 12-839-397 | 285 | 501 | N | | |
| CALPA1 | 12-840-47 | 286 | 501 | N | | |
| CALPA1 | 12-840-77 | 287 | 501 | N | | |
| CALPA1 | 12-841-445 | 288 | 445 | N | | |
| CALPA1 | 12-842-215 | 289 | 501 | N | | |
| CALPA1 | 12-842-447 | 290 | 499 | N | | |
| CALPA1 | 12-844-167 | 291 | 501 | N | | |
| CALPA1 | 12-845-364 | 292 | 501 | N | | |
| CALPA1 | 12-846-209 | 293 | 501 | N | | |
| CALPA1 | 12-847-123 | 294 | 501 | N | | |
| CALPA1 | 12-849-242 | 295 | 501 | N | | |
| CYP2J2 | 10-336-58 | 296 | 501 | N | | |
| CYP2J2 | 10-336-137 | 297 | 501 | N | | |
| CYP2J2 | 10-336-232 | 298 | 501 | N | | |
| CYP2J2 | 12-102-104 | 299 | 379 | N | | |
| CYP2J2 | 12-102-111 | 300 | 386 | N | | |
| CYP2J2 | 12-102-275 | 301 | 501 | N | | |
| CYP2J2 | 12-103-202 | 302 | 501 | Y | C | 14.3 |
| CYP2J2 | 12-103-214 | 303 | 501 | N | | |
| CYP2J2 | 12-104-351 | 304 | 501 | Y | T | 27.4 |
| CYP2J2 | 12-105-435 | 305 | 439 | N | | |
| CYP2J2 | 12-109-149 | 306 | 278 | Y | A | 8.51 |
| CYP2J2 | 12-109-197 | 307 | 326 | N | | |
| CYP2J2 | 12-109-209 | 308 | 338 | N | | |
| CYP2J2 | 12-109-284 | 309 | 413 | N | | |

TABLE 7A-continued

List of all of the eicosanoid-related biallelic markers.

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| CYP2J2 | 12-113-276 | 310 | 501 | Y | G | 31.2 |
| CYP2J2 | 12-115-57 | 311 | 501 | Y | G | 8.87 |
| CYP2J2 | 12-119-26 | 312 | 501 | Y | G | 29.8 |
| COX1 | 12-347-308 | 313 | 501 | N | | |
| COX1 | 12-354-334 | 314 | 501 | Y | C/C | |
| COX1 | 12-357-140 | 315 | 501 | Y | C | 7.14 |
| COX1 | 12-361-320 | 316 | 501 | Y | G | 18.3 |
| COX1 | 12-361-388 | 317 | 501 | Y | A | 18.5 |
| COX1 | 12-365-251 | 318 | 501 | Y | C | 18.8 |
| COX1 | 12-374-261 | 319 | 501 | Y | T | 21.3 |
| COX1 | 10-308-116 | 320 | 501 | N | | |
| COX1 | 10-311-274 | 321 | 501 | N | | |
| COX1 | 10-314-76 | 322 | 501 | N | | |
| COX1 | 10-306-265 | 323 | 501 | N | | |
| COX2 | 10-52-386 | 324 | 386 | N | | |
| COX2 | 10-62-240 | 325 | 240 | Y | C | 12.23 |
| COX2 | 10-65-276 | 326 | 276 | Y | | |
| COX2 | 10-67-42 | 327 | 42 | N | | |
| COX2 | 10-67-340 | 328 | 341 | Y | | |
| COX2 | 10-55-265 | 329 | 264 | Y | C | 40.9 |
| COX2 | 10-57-278 | 330 | 278 | Y | | |
| COX2 | 10-59-176 | 331 | 176 | Y | | |
| COX2 | 10-60-114 | 332 | 114 | N | | |
| PGDS | 10-27-176 | 333 | 176 | Y | A | 5.32 |
| PGDS | 10-28-242 | 334 | 242 | Y | | |
| PGDS | 10-30-349 | 335 | 350 | Y | A/A | |
| PGDS | 10-181-42 | 336 | 42 | Y | C | 30.2 |
| PGDS | 10-181-372 | 337 | 374 | Y | C | 26.3 |
| PGDS | 10-183-260 | 338 | 259 | N | | |
| PG15OH | 10-475-163 | 339 | 501 | N | | |
| PG15OH | 12-884-203 | 340 | 501 | Y | T | 29.7 |
| PG15OH | 10-479-266 | 341 | 501 | N | | |
| PG15OH | 10-479-350 | 342 | 501 | N | | |
| PG15OH | 10-479-394 | 343 | 501 | N | | |
| PG15OH | 10-482-145 | 344 | 501 | N | | |
| PG15OH | 12-854-64 | 345 | 501 | N | | |
| PG15OH | 12-854-472 | 346 | 501 | N | | |
| PG15OH | 12-855-194 | 347 | 501 | N | | |
| PG15OH | 12-855-288 | 348 | 501 | N | | |
| PG15OH | 12-855-423 | 349 | 501 | N | | |
| PG15OH | 12-857-25 | 350 | 476 | N | | |
| PG15OH | 12-858-346 | 351 | 501 | Y | T | 37.2 |
| PG15OH | 12-858-443 | 352 | 501 | N | | |
| PG15OH | 12-860-388 | 353 | 501 | N | | |
| PG15OH | 12-861-270 | 354 | 501 | N | | |
| PG15OH | 12-862-349 | 355 | 501 | N | | |
| PG15OH | 12-862-365 | 356 | 501 | N | | |
| PG15OH | 12-862-452 | 357 | 501 | N | | |
| PG15OH | 12-866-423 | 358 | 501 | Y | C | 46.2 |
| PG15OH | 12-867-47 | 359 | 501 | N | | |
| PG15OH | 12-868-181 | 360 | 501 | N | | |
| PG15OH | 12-868-198 | 361 | 501 | N | | |
| PG15OH | 12-868-282 | 362 | 501 | N | | |
| PG15OH | 12-869-128 | 363 | 501 | N | | |
| PG15OH | 12-870-491 | 364 | 501 | N | | |
| PG15OH | 12-872-52 | 365 | 501 | N | | |
| PG15OH | 12-872-293 | 366 | 501 | N | | |
| PG15OH | 12-873-185 | 367 | 501 | N | | |
| PG15OH | 12-873-319 | 368 | 501 | N | | |
| PG15OH | 12-875-248 | 369 | 501 | Y | G | 28.8 |
| PG15OH | 12-876-265 | 370 | 501 | N | | |
| PG15OH | 12-876-280 | 371 | 501 | N | | |
| PG15OH | 12-876-454 | 372 | 501 | N | | |
| PG15OH | 12-877-59 | 373 | 501 | N | | |
| PG15OH | 12-877-69 | 374 | 501 | N | | |
| PG15OH | 12-877-79 | 375 | 501 | N | | |
| PG15OH | 12-878-153 | 376 | 501 | N | | |
| PG15OH | 12-878-419 | 377 | 501 | N | | |
| PG15OH | 12-879-67 | 378 | 501 | N | | |
| PG15OH | 12-879-439 | 379 | 501 | N | | |
| PG15OH | 12-881-210 | 380 | 501 | N | | |
| PG15OH | 12-881-389 | 381 | 501 | N | | |

TABLE 7A-continued

List of all of the eicosanoid-related biallelic markers.

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| PG15OH | 12-883-273 | 382 | 501 | N | | |
| PG15OH | 12-885-196 | 383 | 501 | N | | |
| PG15OH | 12-885-333 | 384 | 501 | N | | |
| PG15OH | 12-885-407 | 385 | 501 | N | | |
| PG15OH | 12-885-410 | 386 | 501 | N | | |
| PG15OH | 12-886-195 | 387 | 501 | Y | A | 21.1 |
| PG15OH | 12-886-348 | 388 | 501 | N | | |
| PG15OH | 12-887-201 | 389 | 501 | N | | |
| PG15OH | 12-887-467 | 390 | 501 | N | | |
| PG15OH | 12-888-98 | 391 | 501 | N | | |
| PG15OH | 12-888-203 | 392 | 501 | Y | G | 38.3 |
| PG15OH | 12-888-315 | 393 | 501 | N | | |
| PG15OH | 12-889-518 | 394 | 479 | N | | |
| PG15OH | 12-894-266 | 395 | 501 | N | | |
| PG15OH | 12-895-391 | 396 | 501 | Y | C | 34.6 |
| PG15OH | 12-896-140 | 397 | 501 | N | | |
| PG15OH | 12-897-115 | 398 | 501 | N | | |
| PG15OH | 12-897-225 | 399 | 501 | N | | |
| PG15OH | 12-898-49 | 400 | 528 | N | | |
| CYP8 | 12-164-119 | 401 | 501 | Y | C | 11.8 |
| CYP8 | 12-168-84 | 402 | 501 | Y | T | 20.1 |
| CYP8 | 12-168-365 | 403 | 501 | N | | |
| CYP8 | 12-170-299 | 404 | 501 | Y | T | 6.52 |
| CYP8 | 12-171-360 | 405 | 501 | Y | T | 8.70 |
| CYP8 | 12-173-59 | 406 | 501 | Y | G | 26.0 |
| CYP8 | 12-175-214 | 407 | 501 | Y | A | 10.1 |
| CYP8 | 12-177-183 | 408 | 501 | Y | G | 25.4 |
| CYP8 | 12-177-366 | 409 | 501 | N | | |
| TAX2 | 10-128-45 | 410 | 45 | Y | T/T | |
| TAX2 | 10-128-63 | 411 | 63 | N | | |
| TAX2 | 10-123-177 | 412 | 177 | N | | |
| TAX2 | 10-123-402 | 413 | 402 | N | | |
| TAX2 | 10-120-137 | 414 | 136 | Y | A | 1.60 |
| TAX2 | 10-120-141 | 415 | 140 | Y | A | 3.09 |
| TAX2 | 10-179-39 | 416 | 39 | N | | |
| TAX2 | 10-180-65 | 417 | 65 | Y | C | 44.7 |
| TAX2 | 10-179-257 | 418 | 257 | Y | | |
| 15-LOA | 10-43-124 | 419 | 123 | N | | |
| 15-LOA | 10-43-134 | 420 | 133 | N | | |
| 15-LOA | 10-43-193 | 421 | 192 | N | | |
| 15-LOA | 10-43-195 | 422 | 194 | N | | |
| 15-LOA | 10-43-233 | 423 | 232 | N | | |
| 15-LOA | 10-43-138 | 424 | 137 | Y | | |
| 15-LOA | 10-46-372 | 425 | 369 | Y | T | 2.43 |
| 15-LOA | 10-46-36 | 426 | 35 | N | | |
| 15-LOA | 10-47-103 | 427 | 102 | Y | | |
| 15-LOA | 10-47-125 | 428 | 124 | Y | T | 5.68 |
| 15-LOA | 10-48-184 | 429 | 183 | Y | T | 28.0 |
| 15-LOA | 10-48-381 | 430 | 382 | Y | T | 31.4 |
| 15-LOA | 10-49-33 | 431 | 33 | Y | T | 14.3 |
| 15-LOA | 10-39-148 | 432 | 150 | Y | G | 14.5 |
| 15-LOA | 10-40-222 | 433 | 222 | Y | A | 47.6 |
| 15-LOA | 10-40-252 | 434 | 250 | N | | |
| 15-LOA | 10-42-354 | 435 | 354 | Y | | |
| 15-LOA | 10-154-42 | 436 | 42 | N | | |
| 15-LOA | 10-154-156 | 437 | 156 | Y | T | 24.2 |
| 15-LOA | 10-154-226 | 438 | 226 | N | | |
| 15-LOB | 12-776-259 | 439 | 501 | N | | |
| 5-LO | 10-384-109 | 440 | 501 | N | | |
| 5-LO | 12-296-388 | 441 | 501 | Y | G | 37.6 |
| 5-LO | 10-388-379 | 442 | 501 | N | | |
| 5-LO | 10-389-116 | 443 | 501 | N | | |
| 5-LO | 10-389-349 | 444 | 501 | N | | |
| 5-LO | 10-391-94 | 445 | 501 | N | | |
| 5-LO | 12-277-147 | 446 | 501 | Y | T | 44.9 |
| 5-LO | 12-278-413 | 447 | 501 | Y | A | 33.9 |
| 5-LO | 12-288-190 | 448 | 501 | N | | |
| 5-LO | 12-289-35 | 449 | 501 | N | | |
| 5-LO | 12-296-119 | 450 | 501 | N | | |
| 5-LO | 12-297-291 | 451 | 501 | N | | |
| 5-LO | 12-298-105 | 452 | 501 | N | | |
| 5-LO | 12-300-126 | 453 | 501 | N | | |

TABLE 7A-continued

List of all of the eicosanoid-related biallelic markers.

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| 5-LO | 12-300-410 | 454 | 501 | N | | |
| 5-LO | 12-301-379 | 455 | 501 | N | | |
| 5-LO | 12-302-264 | 456 | 501 | N | | |
| 5-LO | 12-309-405 | 457 | 501 | N | | |
| 5-LO | 12-310-105 | 458 | 501 | N | | |
| 5-LO | 12-314-453 | 459 | 501 | Y | A | 18.8 |
| 5-LO | 12-316-292 | 460 | 501 | Y | C | 40.8 |
| LTA4H | 10-281-314 | 461 | 501 | N | | |
| LTA4H | 10-268-381 | 462 | 501 | N | | |
| LTA4H | 12-54-297 | 463 | 501 | Y | C | 9.34 |
| LTA4H | 10-276-407 | 464 | 501 | N | | |
| LTA4H | 12-44-50 | 465 | 501 | Y | A | 25.9 |
| LTA4H | 12-44-67 | 466 | 501 | N | | |
| LTA4H | 12-45-145 | 467 | 501 | N | | |
| LTA4H | 12-45-166 | 468 | 501 | N | | |
| LTA4H | 12-45-305 | 469 | 501 | N | | |
| LTA4H | 12-46-92 | 470 | 501 | Y | G | 31.9 |
| LTA4H | 12-47-132 | 471 | 501 | Y | C | 4.84 |
| LTA4H | 12-47-61 | 472 | 501 | N | | |
| LTA4H | 12-48-100 | 473 | 501 | N | | |
| LTA4H | 12-48-323 | 474 | 501 | N | | |
| LTA4H | 12-48-369 | 475 | 501 | N | | |
| LTA4H | 12-48-37 | 476 | 501 | N | | |
| LTA4H | 12-49-131 | 477 | 501 | Y | A | 40.1 |
| LTA4H | 12-49-53 | 478 | 501 | N | | |
| LTA4H | 12-49-64 | 479 | 501 | N | | |
| LTA4H | 12-51-234 | 480 | 501 | Y | A | 43.3 |
| LTA4H | 12-51-253 | 481 | 501 | N | | |
| LTA4H | 12-51-370 | 482 | 501 | N | | |
| LTA4H | 12-52-400 | 483 | 501 | N | | |
| LTA4H | 12-57-192 | 484 | 501 | Y | T | 41.2 |
| LTA4H | 12-57-221 | 485 | 501 | Y | T | 4.40 |
| LTA4H | 12-57-510 | 486 | 501 | N | | |
| LTB4H2 | 10-1-139 | 487 | 139 | Y | G | 36.3 |
| LTB4H2 | 10-1-212 | 488 | 212 | Y | T | 16.3 |
| LTB4H2 | 10-1-241 | 489 | 241 | Y | A | 5.84 |
| LTB4H2 | 10-9-143 | 490 | 143 | Y | | |
| LTB4H2 | 10-9-185 | 491 | 185 | Y | T/T | |
| LTB4H2 | 10-9-264 | 492 | 264 | Y | | |
| LTB4H2 | 10-11-22 | 493 | 22 | N | | |
| LTB4H2 | 10-13-152 | 494 | 152 | Y | T | 20.8 |
| LTB4H2 | 10-13-256 | 495 | 256 | Y | | |
| LTB4H2 | 10-13-282 | 496 | 282 | Y | C | 25.0 |
| LTB4H2 | 10-15-281 | 497 | 281 | N | | |
| LTB4H2 | 10-17-142 | 498 | 142 | Y | C/C | |
| LTB4H2 | 10-18-302 | 499 | 302 | N | | |
| LTB4H2 | 10-23-331 | 500 | 331 | N | | |
| LTB4H2 | 10-25-152 | 501 | 152 | Y | | |
| LTB4H2 | 10-25-258 | 502 | 258 | N | | |
| LTB4H2 | 10-3-103 | 503 | 103 | Y | T | 47.7 |
| LTB4H2 | 10-3-144 | 504 | 144 | Y | | |
| LTB4H2 | 10-3-275 | 505 | 275 | Y | | |
| LTB4H2 | 10-5-227 | 506 | 227 | Y | A | 28.1 |
| LTB4H2 | 10-7-155 | 507 | 155 | Y | T | 30.4 |
| LTB4H2 | 10-7-383 | 508 | 381 | N | | |
| LTB4H2 | 10-7-98 | 509 | 98 | N | | |
| LTB412OH | 12-561-270 | 510 | 501 | Y | T | 35.2 |
| LTB412OH | 12-563-87 | 511 | 501 | Y | C | 28.0 |
| LTB412OH | 12-564-64 | 512 | 501 | Y | T | 36.0 |
| LTB412OH | 12-564-214 | 513 | 501 | N | | |
| LTB412OH | 12-568-207 | 514 | 501 | N | | |
| LTB412OH | 12-568-365 | 515 | 501 | N | | |
| LTB412OH | 12-568-367 | 516 | 501 | N | | |
| LTB412OH | 12-571-337 | 517 | 501 | Y | G | 17.9 |
| LTB412OH | 12-573-378 | 518 | 501 | Y | A | 6.91 |
| LTB412OH | 10-294-256 | 519 | 501 | N | | |
| LTB412OH | 10-294-304 | 520 | 501 | N | | |
| LTB412OH | 10-295-201 | 521 | 501 | N | | |
| LTB412OH | 10-296-80 | 522 | 501 | N | | |
| LTB412OH | 10-296-373 | 523 | 501 | N | | |
| LTB412OH | 10-298-122 | 524 | 501 | N | | |
| LTB412OH | 10-298-158 | 525 | 501 | N | | |

TABLE 7A-continued

List of all of the eicosanoid-related biallelic markers.

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| LTB412OH | 10-300-49 | 526 | 501 | N | | |
| LTB412OH | 10-300-185 | 527 | 501 | N | | |
| LTB4H3 | 10-10-328 | 528 | 327 | Y | A | 12.5 |
| LTB4H3 | 10-12-52 | 529 | 52 | N | | |
| LTB4H3 | 10-14-46 | 530 | 46 | Y | T | 39.3 |
| LTB4H3 | 10-19-358 | 531 | 357 | Y | | |
| LTB4H3 | 10-20-111 | 532 | 110 | Y | A | 15.8 |
| LTB4H3 | 10-20-274 | 533 | 273 | Y | A/A | |
| LTB4H3 | 10-24-90 | 534 | 90 | Y | C | 19.2 |
| LTB4H3 | 10-24-204 | 535 | 204 | Y | A | 25.0 |
| LTB4H3 | 10-24-221 | 536 | 221 | N | | |
| LTB4H3 | 10-24-234 | 537 | 234 | Y | A | 36.1 |
| LTB4H3 | 10-24-288 | 538 | 288 | N | | |
| LTB4H3 | 10-24-311 | 539 | 311 | N | | |
| LTB4H3 | 10-26-289 | 540 | 289 | N | | |
| LTB4H3 | 10-8-39 | 541 | 39 | Y | | |
| LTB4H3 | 10-8-120 | 542 | 120 | N | | |
| LTB4H3 | 10-8-154 | 543 | 154 | N | | |
| LTB4H3 | 10-8-101 | 544 | 101 | Y | | |
| LTB4H3 | 10-8-86 | 545 | 86 | Y | | |
| LTB4H3 | 10-8-92 | 546 | 92 | N | | |
| LTB4H3 | 10-8-94 | 547 | 94 | N | | |
| LTB4R | 12-61-472 | 548 | 501 | N | | |
| LTB4R | 12-63-402 | 549 | 416 | N | | |
| LTB4R | 12-63-74 | 550 | 88 | N | | |
| LTB4R | 12-64-271 | 551 | 287 | Y | C | 28.6 |
| LTB4R | 12-65-98 | 552 | 439 | N | | |
| LTB4R | 12-70-147 | 553 | 501 | Y | C | 11.5 |
| LTB4R | 12-70-397 | 554 | 501 | Y | T | 39.7 |
| LTB4R | 12-71-320 | 555 | 501 | Y | A | 4.49 |
| LTB4R | 12-73-150 | 556 | 501 | N | | |
| LTB4R | 12-73-49 | 557 | 501 | Y | A | 43.3 |
| LTB4R | 12-73-56 | 558 | 501 | N | | |
| LTB4R | 12-74-38 | 559 | 501 | Y | C | 44.1 |
| LTB4R | 12-76-238 | 560 | 501 | Y | T | 20.6 |
| LTB4R | 12-77-217 | 561 | 501 | N | | |
| LTB4R | 12-77-478 | 562 | 501 | Y | A | 4.40 |
| LTB4R | 12-80-114 | 563 | 501 | N | | |
| LTB4R | 12-80-233 | 564 | 501 | Y | C | 4.55 |
| LTB4R | 12-82-250 | 565 | 250 | N | | |
| LTC4 | 10-176-85 | 566 | 85 | Y | T | 0.54 |
| LTC4 | 10-176-51 | 567 | 51 | N | | |
| LTC4 | 10-176-207 | 568 | 207 | N | | |
| LTC4 | 10-176-397 | 569 | 397 | Y | A | 1.63 |
| LTC4 | 10-177-219 | 570 | 219 | Y | C | 29.0 |
| 12-LO | 12-214-85 | 571 | 85 | N | | |
| 12-LO | 12-215-272 | 572 | 271 | N | | |
| 12-LO | 12-221-163 | 573 | 163 | N | | |
| 12-LO | 12-225-82 | 574 | 82 | N | | |
| cPLA$_2$ | 10-234-179 | 575 | 214 | Y | Deletion AA | 32.6 |
| cPLA$_2$ | 10-235-272 | 576 | 491 | N | | |
| ANX1 | 10-251-342 | 577 | 498 | N | | |
| ANX2 | 10-395-367 | 578 | 497 | N | | |
| ANX2 | 12-730-58 | 579 | 498 | N | | |
| ANX2 | 12-735-208 | 580 | 412 | Y | Deletion | 21.5 |
| ANX2 | 12-739-22 | 581 | 498 | Y | Insertion G | 23.4 |
| ANX3 | 12-540-363 | 582 | 498 | N | | |
| ANX3 | 12-550-206 | 583 | 497 | N | | |
| CAL2 | 12-207-410 | 584 | 409 | N | | |
| CAL3 | 10-171-254 | 585 | 255 | N | | |
| CALPA1 | 12-94-110 | 586 | 498 | Y | Deletion AATT | 32.5 |
| CALPA1 | 12-834-290 | 587 | 498 | N | | |
| COX2 | 10-55-115 | 588 | 114 | Y | Deletion TTATA | 3.01 |
| PG15OH | 12-857-122 | 589 | 498 | N | | |
| PG15OH | 12-872-175 | 590 | 498 | N | | |
| PG15OH | 12-882-40 | 591 | 498 | N | | |
| PG15OH | 12-888-234 | 592 | 498 | N | | |
| 5-LO | 12-278-353 | 593 | 499 | N | | |
| 5-LO | 12-283-386 | 594 | 498 | N | | |
| LTA4H | 12-44-181 | 595 | 458 | N | | |

TABLE 7A-continued

List of all of the eicosanoid-related biallelic markers.

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE FREQUENCY % |
|---|---|---|---|---|---|
| ANX3 | 10-370-132 | 596 | 501 | N | |
| ANX3 | 10-370-254 | 597 | 501 | N | |
| 15PGDHB | 10-485-256 | 598 | 501 | N | |
| 15PGDHB | 10-485-257 | 599 | 501 | N | |
| 15PGDHB | 10-474-320 | 600 | 501 | N | |
| 5LO | 10-387-371 | 601 | 501 | N | |
| LTB412OH | 12-570-239 | 602 | 501 | N | |
| LTB412OH | 12-570-344 | 603 | 501 | N | |
| LTB412OH | 12-570-393 | 604 | 501 | N | |
| LTB412OH | 12-570-421 | 605 | 501 | N | |
| LTB412OH | 12-570-62 | 606 | 502 | N | |
| LTB4H3 | 10-4-144 | 607 | 141 | N | |
| LTB4H3 | 10-4-161 | 608 | 158 | N | |
| LTB4H3 | 10-4-270 | 609 | 267 | N | |
| LTB4H3 | 10-4-340 | 610 | 337 | N | |
| LTB4H3 | 10-4-369 | 611 | 366 | N | |
| LTB4H3 | 10-4-420 | 612 | 417 | N | |
| LTB4H2 | 10-13-396 | 613 | 396 | N | |
| 12-LO | 10-509-284 | 614 | 501 | N | |
| 12-LO | 10-509-295 | 615 | 501 | N | |
| 12-LO | 10-339-124 | 616 | 501 | N | |
| 12-LO | 10-340-112 | 617 | 501 | N | |
| 12-LO | 10-340-130 | 618 | 501 | N | |
| 12-LO | 10-340-238 | 619 | 501 | N | |
| 12-LO | 10-342-301 | 620 | 501 | N | |
| 12-LO | 10-342-373 | 621 | 501 | N | |
| 12-LO | 10-343-231 | 622 | 501 | N | |
| 12-LO | 10-343-278 | 623 | 501 | N | |
| 12-LO | 10-346-141 | 624 | 501 | N | G/G |
| 12-LO | 10-346-23 | 625 | 500 | N | |
| 12-LO | 10-346-263 | 626 | 501 | N | |
| 12-LO | 10-346-305 | 627 | 501 | N | |
| 12-LO | 10-349-216 | 628 | 501 | N | |
| 12-LO | 10-350-332 | 629 | 501 | N | |
| 12-LO | 10-350-72 | 630 | 501 | N | |
| 12-LO | 10-507-170 | 631 | 501 | N | |
| 12-LO | 10-507-321 | 632 | 501 | N | |
| 12-LO | 10-507-353 | 633 | 501 | N | |
| 12-LO | 10-507-364 | 634 | 501 | N | |
| 12-LO | 10-507-405 | 635 | 501 | N | |
| 12-LO | 10-508-191 | 636 | 501 | N | |
| 12-LO | 10-508-245 | 637 | 501 | N | |
| 12-LO | 10-510-173 | 638 | 501 | N | |
| 12-LO | 10-511-337 | 639 | 501 | N | |
| 12-LO | 10-512-36 | 640 | 501 | Y | C    39.4 |
| 12-LO | 10-511-62 | 641 | 501 | N | |
| 12-LO | 10-512-318 | 642 | 501 | N | |
| 12-LO | 10-513-250 | 643 | 501 | N | |
| 12-LO | 10-513-262 | 644 | 501 | N | |
| 12-LO | 10-513-352 | 645 | 501 | N | |
| 12-LO | 10-513-365 | 646 | 501 | N | |
| FLAP | 10-517-100 | 647 | 501 | N | |
| FLAP | 10-518-125 | 648 | 501 | N | |
| FLAP | 10-518-194 | 649 | 501 | N | |
| FLAP | 10-522-71 | 650 | 501 | N | |

TABLE 7B

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE FREQUENCY % |
|---|---|---|---|---|---|
| FLAP | 10-253-118 | 655 | 24 | N | |
| FLAP | 10-253-298 | 656 | 24 | Y | G    4.57 |
| FLAP | 10-253-315 | 657 | 24 | N | |
| FLAP | 10-499-155 | 658 | 24 | N | |

TABLE 7B-continued

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| FLAP | 10-520-256 | 659 | 24 | N | T | 40.8 |
| FLAP | 10-500-258 | 660 | 24 | N | | |
| FLAP | 10-500-410 | 661 | 24 | N | | |
| FLAP | 10-503-159 | 662 | 24 | N | | |
| FLAP | 10-504-172 | 663 | 24 | N | | |
| FLAP | 10-504-243 | 664 | 24 | N | | |
| FLAP | 10-204-326 | 665 | 24 | Y | A | 6.63 |
| FLAP | 10-32-357 | 666 | 24 | Y | A | 33.5 |
| FLAP | 10-33-175 | 667 | 24 | Y | T | 2.30 |
| FLAP | 10-33-211 | 668 | 24 | N | | |
| FLAP | 10-33-234 | 669 | 24 | Y | A | 44.0 |
| FLAP | 10-33-270 | 670 | 24 | Y | G/G | |
| FLAP | 10-33-327 | 671 | 24 | Y | C | 24.5 |
| FLAP | 10-34-290 | 672 | 24 | N | | |
| FLAP | 10-35-358 | 673 | 24 | Y | C | 31.3 |
| FLAP | 10-35-390 | 674 | 24 | Y | T | 23.0 |
| FLAP | 10-36-164 | 675 | 24 | Y | G/G | |
| FLAP | 10-498-192 | 676 | 24 | N | | |
| FLAP | 12-628-306 | 677 | 24 | Y | T | 10.3 |
| FLAP | 12-628-311 | 678 | 24 | N | | |
| FLAP | 12-629-241 | 679 | 24 | Y | C | 28.3 |
| 12-LO | 12-206-366 | 680 | 24 | Y | C | 38.2 |
| 12-LO | 10-343-339 | 681 | 24 | N | | |
| 12-LO | 10-347-74 | 682 | 24 | N | | |
| 12-LO | 10-347-111 | 683 | 24 | N | G/G | |
| 12-LO | 10-347-165 | 684 | 24 | N | C/C | |
| 12-LO | 10-347-203 | 685 | 24 | Y | G | 41.6 |
| 12-LO | 10-347-220 | 686 | 24 | Y | A | 40.5 |
| 12-LO | 10-347-271 | 687 | 24 | N | | |
| 12-LO | 10-347-348 | 688 | 24 | N | | |
| 12-LO | 10-348-391 | 689 | 24 | N | | |
| 12-LO | 10-349-47 | 690 | 24 | N | | |
| 12-LO | 10-349-97 | 691 | 24 | Y | G | 39.6 |
| 12-LO | 10-349-142 | 692 | 24 | N | C/C | |
| 12-LO | 10-349-224 | 693 | 24 | Y | T | 39.6 |
| 12-LO | 10-349-368 | 694 | 24 | N | | |
| 12-LO | 10-339-32 | 695 | 24 | N | | |
| 12-LO | 10-341-116 | 696 | 24 | Y | A | 10.8 |
| 12-LO | 10-341-319 | 697 | 24 | N | | |
| 12-LO | 12-196-119 | 698 | 24 | Y | C | 29.1 |
| 12-LO | 12-197-244 | 699 | 24 | Y | C | 32.8 |
| 12-LO | 12-198-128 | 700 | 24 | N | | |
| 12-LO | 12-206-81 | 701 | 24 | N | | |
| 12-LO | 12-208-35 | 702 | 24 | Y | A | 42.3 |
| 12-LO | 12-214-129 | 703 | 24 | Y | C | 38.7 |
| 12-LO | 12-214-151 | 704 | 24 | N | | |
| 12-LO | 12-214-360 | 705 | 24 | N | | |
| 12-LO | 12-215-467 | 706 | 24 | N | | |
| 12-LO | 12-216-421 | 707 | 24 | Y | A | 36.0 |
| 12-LO | 12-219-230 | 708 | 24 | Y | G | 32.1 |
| 12-LO | 12-219-256 | 709 | 24 | N | | |
| 12-LO | 12-220-48 | 710 | 24 | N | | |
| 12-LO | 12-221-302 | 711 | 24 | N | | |
| 12-LO | 12-223-179 | 712 | 24 | N | | |
| 12-LO | 12-223-207 | 713 | 24 | Y | C | 38.4 |
| 12-LO | 12-225-541 | 714 | 24 | Y | C | 37.4 |
| 12-LO | 12-226-167 | 715 | 24 | Y | G | 41.2 |
| 12-LO | 12-226-458 | 716 | 24 | N | | |
| 12-LO | 12-229-332 | 717 | 24 | N | | |
| 12-LO | 12-229-351 | 718 | 24 | N | | |
| 12-LO | 12-230-364 | 719 | 24 | N | | |
| 12-LO | 12-231-100 | 720 | 24 | N | | |
| 12-LO | 12-231-148 | 721 | 24 | N | | |
| 12-LO | 12-231-266 | 722 | 24 | N | | |
| cPLA$_2$ | 10-231-23 | 723 | 24 | Y | A | 8.79 |
| cPLA$_2$ | 10-233-386 | 724 | 24 | Y | G | 28.3 |
| cPLA$_2$ | 10-239-368 | 726 | 24 | N | | |
| cPLA$_2$ | 10-223-30 | 727 | 24 | Y | G | 22.5 |
| cPLA$_2$ | 10-223-72 | 728 | 24 | N | | |
| cPLA$_2$ | 10-223-130 | 729 | 24 | N | | |
| cPLA$_2$ | 10-223-262 | 730 | 24 | N | | |
| cPLA$_2$ | 10-223-392 | 731 | 24 | N | | |

TABLE 7B-continued

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| cPLA$_2$ | 10-224-341 | 732 | 24 | N | | |
| cPLA$_2$ | 10-227-282 | 733 | 24 | Y | G | 3.93 |
| ANX1 | 10-240-241 | 734 | 24 | N | | |
| ANX1 | 10-249-185 | 735 | 24 | N | | |
| ANX1 | 10-251-128 | 736 | 24 | N | | |
| ANX1 | 10-252-209 | 737 | 24 | N | | |
| ANX1 | 12-387-32 | 738 | 24 | Y | G | 33.9 |
| ANX1 | 10-242-316 | 739 | 24 | N | | |
| ANX1 | 10-245-412 | 740 | 24 | N | | |
| ANX1 | 12-378-171 | 741 | 24 | N | | |
| ANX1 | 12-378-228 | 742 | 24 | N | | |
| ANX1 | 12-378-450 | 743 | 24 | N | | |
| ANX1 | 12-379-65 | 744 | 24 | N | | |
| ANX1 | 12-382-204 | 745 | 24 | Y | G | 50.0 |
| ANX1 | 12-383-117 | 746 | 24 | N | | |
| ANX1 | 12-383-170 | 747 | 24 | N | | |
| ANX1 | 12-383-268 | 748 | 24 | N | | |
| ANX1 | 12-384-336 | 749 | 24 | N | | |
| ANX1 | 12-384-451 | 750 | 24 | N | | |
| ANX1 | 12-385-123 | 751 | 24 | N | | |
| ANX1 | 12-385-427 | 752 | 24 | N | | |
| ANX1 | 12-386-155 | 753 | 24 | Y | G | 8.15 |
| ANX1 | 12-386-24 | 754 | 24 | N | | |
| ANX1 | 12-387-177 | 755 | 24 | Y | T | 33.5 |
| ANX1 | 12-389-431 | 756 | 24 | N | | |
| ANX1 | 12-391-366 | 757 | 24 | N | | |
| ANX1 | 12-394-85 | 758 | 24 | N | | |
| ANX1 | 12-395-382 | 759 | 24 | N | | |
| ANX1 | 12-400-217 | 760 | 24 | Y | G | 27.2 |
| ANX1 | 12-400-280 | 761 | 24 | N | | |
| ANX1 | 12-401-378 | 762 | 24 | N | | |
| ANX1 | 12-402-126 | 763 | 24 | N | | |
| ANX1 | 12-404-265 | 764 | 24 | N | | |
| ANX1 | 12-406-52 | 765 | 24 | N | | |
| ANX1 | 12-406-409 | 766 | 24 | N | | |
| ANX1 | 12-407-217 | 767 | 24 | N | | |
| ANX1 | 12-407-399 | 768 | 24 | N | | |
| ANX1 | 12-408-355 | 769 | 24 | Y | G | 2.69 |
| ANX1 | 12-409-221 | 770 | 24 | N | | |
| ANX1 | 12-410-301 | 771 | 24 | N | | |
| ANX2 | 10-395-101 | 772 | 24 | N | | |
| ANX2 | 10-395-124 | 773 | 24 | N | | |
| ANX2 | 10-395-155 | 774 | 24 | N | | |
| ANX2 | 10-395-294 | 775 | 24 | N | | |
| ANX2 | 10-396-100 | 776 | 24 | N | | |
| ANX2 | 10-397-201 | 777 | 24 | N | | |
| ANX2 | 10-399-178 | 778 | 24 | N | | |
| ANX2 | 10-400-369 | 779 | 24 | N | | |
| ANX2 | 10-392-20 | 780 | 24 | N | | |
| ANX2 | 10-392-103 | 781 | 24 | N | | |
| ANX2 | 10-392-324 | 782 | 24 | N | | |
| ANX2 | 10-393-27 | 783 | 24 | N | | |
| ANX2 | 10-393-324 | 784 | 24 | N | | |
| ANX2 | 12-727-237 | 785 | 24 | N | | |
| ANX2 | 12-728-224 | 786 | 24 | N | | |
| ANX2 | 12-730-142 | 787 | 24 | N | | |
| ANX2 | 12-730-193 | 788 | 24 | N | | |
| ANX2 | 12-731-60 | 789 | 24 | N | | |
| ANX2 | 12-731-119 | 790 | 24 | N | | |
| ANX2 | 12-731-137 | 791 | 24 | N | | |
| ANX2 | 12-731-146 | 792 | 24 | N | | |
| ANX2 | 12-731-398 | 793 | 24 | N | | |
| ANX2 | 12-732-113 | 794 | 24 | N | | |
| ANX2 | 12-732-164 | 795 | 24 | N | | |
| ANX2 | 12-732-165 | 796 | 24 | Y | C | 27.4 |
| ANX2 | 12-732-445 | 797 | 24 | N | | |
| ANX2 | 12-734-201 | 798 | 24 | N | | |
| ANX2 | 12-735-42 | 799 | 24 | N | | |
| ANX2 | 12-736-363 | 800 | 24 | N | | |
| ANX2 | 12-737-69 | 801 | 24 | Y | A | 36.8 |
| ANX2 | 12-737-296 | 802 | 24 | N | | |
| ANX2 | 12-738-429 | 803 | 24 | Y | T | 35.5 |

TABLE 7B-continued

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| ANX2 | 12-740-112 | 804 | 24 | Y | G | 37.6 |
| ANX2 | 12-740-118 | 805 | 24 | N | | |
| ANX2 | 12-741-265 | 806 | 24 | N | | |
| ANX2 | 12-741-327 | 807 | 24 | N | | |
| ANX2 | 12-741-376 | 808 | 24 | N | | |
| ANX2 | 12-745-30 | 809 | 24 | N | | |
| ANX2 | 12-745-75 | 810 | 24 | N | | |
| ANX2 | 12-745-343 | 811 | 24 | N | | |
| ANX2 | 12-745-350 | 812 | 24 | N | | |
| ANX2 | 12-746-320 | 813 | 24 | N | | |
| ANX2 | 12-747-181 | 814 | 24 | N | | |
| ANX2 | 12-747-302 | 815 | 24 | N | | |
| ANX2 | 12-749-240 | 816 | 24 | N | | |
| ANX2 | 12-749-255 | 817 | 24 | N | | |
| ANX2 | 12-752-37 | 818 | 24 | N | | |
| ANX2 | 12-752-85 | 819 | 24 | N | | |
| ANX2 | 12-752-196 | 820 | 24 | N | | |
| ANX2 | 12-752-484 | 821 | 24 | N | | |
| ANX2 | 12-753-139 | 822 | 24 | N | | |
| ANX2 | 12-753-376 | 823 | 24 | N | | |
| ANX2 | 12-754-172 | 824 | 24 | N | | |
| ANX2 | 12-754-218 | 825 | 24 | N | | |
| ANX2 | 12-754-328 | 826 | 24 | N | | |
| ANX2 | 12-754-396 | 827 | 24 | N | | |
| ANX2 | 12-755-280 | 828 | 24 | N | | |
| ANX2 | 12-757-384 | 829 | 24 | N | | |
| ANX2 | 12-758-257 | 830 | 24 | N | | |
| ANX2 | 12-758-374 | 831 | 24 | N | | |
| ANX2 | 12-758-424 | 832 | 24 | N | | |
| ANX2 | 12-761-23 | 833 | 24 | N | | |
| ANX2 | 12-761-178 | 834 | 24 | N | | |
| ANX2 | 12-764-329 | 835 | 24 | N | | |
| ANX2 | 12-764-377 | 836 | 24 | N | | |
| ANX2 | 12-765-168 | 837 | 24 | N | | |
| ANX2 | 12-765-504 | 838 | 24 | N | | |
| ANX3 | 10-372-279 | 839 | 24 | N | | |
| ANX3 | 10-375-136 | 840 | 24 | N | | |
| ANX3 | 10-376-281 | 841 | 24 | N | | |
| ANX3 | 10-369-392 | 842 | 24 | N | | |
| ANX3 | 10-371-257 | 843 | 24 | N | | |
| ANX3 | 12-513-389 | 844 | 24 | N | | |
| ANX3 | 12-513-494 | 845 | 24 | N | | |
| ANX3 | 12-515-394 | 846 | 24 | N | | |
| ANX3 | 12-516-97 | 847 | 24 | Y | T | 37.2 |
| ANX3 | 12-520-287 | 848 | 24 | N | | |
| ANX3 | 12-520-323 | 849 | 24 | Y | A | 21.5 |
| ANX3 | 12-523-179 | 850 | 24 | Y | A | 29.9 |
| ANX3 | 12-523-270 | 851 | 24 | N | | |
| ANX3 | 12-527-367 | 852 | 24 | Y | T | 18.9 |
| ANX3 | 12-529-376 | 853 | 24 | N | | |
| ANX3 | 12-529-489 | 854 | 24 | N | | |
| ANX3 | 12-530-134 | 855 | 24 | Y | T | 39.3 |
| ANX3 | 12-530-393 | 856 | 24 | N | | |
| ANX3 | 12-531-173 | 857 | 24 | Y | C | 37.6 |
| ANX3 | 12-539-441 | 858 | 24 | N | | |
| ANX3 | 12-543-78 | 859 | 24 | N | | |
| ANX3 | 12-543-79 | 860 | 24 | N | | |
| ANX3 | 12-546-235 | 861 | 24 | N | | |
| ANX3 | 12-549-287 | 862 | 24 | N | | |
| ANX3 | 12-550-287 | 863 | 24 | N | | |
| ANX3 | 12-552-175 | 864 | 24 | N | | |
| ANX3 | 12-554-330 | 865 | 24 | N | | |
| ANX3 | 12-556-312 | 866 | 24 | N | | |
| ANX3 | 12-556-443 | 867 | 24 | N | | |
| ANX3 | 12-558-205 | 868 | 24 | N | | |
| ANX3 | 12-558-238 | 869 | 24 | N | | |
| ANX3 | 12-558-305 | 870 | 24 | N | | |
| ANX3 | 12-769-39 | 871 | 24 | N | | |
| ANX3 | 12-769-430 | 872 | 24 | N | | |
| ANX3 | 12-770-73 | 873 | 24 | N | | |
| ANX3 | 12-772-200 | 874 | 24 | N | | |
| ANX3 | 12-772-254 | 875 | 24 | N | | |

TABLE 7B-continued

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| CAL1 | 10-87-73 | 876 | 24 | N | | |
| CAL1 | 10-87-74 | 877 | 24 | N | | |
| CAL1 | 10-87-80 | 878 | 24 | N | | |
| CAL1 | 10-87-140 | 879 | 24 | N | | |
| CAL1 | 10-88-81 | 880 | 24 | Y | C | 44.7 |
| CAL1 | 10-89-41 | 881 | 24 | N | | |
| CAL1 | 10-90-35 | 882 | 24 | Y | A | 1.14 |
| CAL1 | 10-91-274 | 883 | 24 | N | | |
| CAL1 | 10-93-133 | 884 | 24 | N | | |
| CAL1 | 10-94-197 | 885 | 24 | Y | G/G | |
| CAL1 | 10-94-198 | 886 | 24 | N | | |
| CAL1 | 10-166-362 | 887 | 24 | N | | |
| CAL2 | 10-207-386 | 888 | 24 | Y | C/C | |
| CAL2 | 10-207-409 | 889 | 24 | Y | G | 9.04 |
| CAL2 | 10-118-307 | 890 | 24 | Y | A | 0.27 |
| CAL2 | 10-173-247 | 891 | 24 | N | | |
| CAL2 | 10-173-294 | 892 | 24 | Y | G | 2.87 |
| CAL2 | 10-173-347 | 893 | 24 | Y | C/C | |
| CAL3 | 10-103-104 | 894 | 24 | N | | |
| CAL3 | 10-103-323 | 895 | 24 | Y | T | 22.3 |
| CAL3 | 10-103-402 | 896 | 24 | N | | |
| CAL3 | 10-106-98 | 897 | 24 | N | | |
| CAL3 | 10-106-288 | 898 | 24 | Y | | |
| CAL3 | 10-106-378 | 899 | 24 | Y | | |
| CAL3 | 10-168-160 | 900 | 24 | Y | T | 42.1 |
| CAL3 | 10-168-206 | 901 | 24 | Y | | |
| CAL3 | 10-168-284 | 902 | 24 | N | | |
| CAL3 | 10-169-318 | 903 | 24 | N | | |
| CALPA1 | 12-86-79 | 904 | 24 | Y | C | 37.4 |
| CALPA1 | 12-88-393 | 905 | 24 | N | | |
| CALPA1 | 12-89-369 | 906 | 24 | Y | G | 36.3 |
| CALPA1 | 12-89-91 | 907 | 24 | N | | |
| CALPA1 | 12-94-210 | 908 | 24 | N | | |
| CALPA1 | 12-94-516 | 909 | 24 | N | | |
| CALPA1 | 12-96-64 | 910 | 24 | Y | T | 8.52 |
| CALPA1 | 12-97-83 | 911 | 24 | N | | |
| CALPA1 | 12-99-296 | 912 | 24 | Y | T | 6.45 |
| CALPA1 | 12-100-266 | 913 | 24 | Y | G | 32.2 |
| CALPA1 | 12-811-174 | 914 | 24 | N | | |
| CALPA1 | 12-815-94 | 915 | 24 | N | | |
| CALPA1 | 12-815-383 | 916 | 24 | N | | |
| CALPA1 | 12-815-384 | 917 | 24 | N | | |
| CALPA1 | 12-815-391 | 918 | 24 | N | | |
| CALPA1 | 12-817-214 | 919 | 24 | N | | |
| CALPA1 | 12-817-355 | 920 | 24 | N | | |
| CALPA1 | 12-819-437 | 921 | 24 | N | | |
| CALPA1 | 12-821-62 | 922 | 24 | N | | |
| CALPA1 | 12-821-483 | 923 | 24 | N | | |
| CALPA1 | 12-825-173 | 924 | 24 | N | | |
| CALPA1 | 12-826-312 | 925 | 24 | N | | |
| CALPA1 | 12-831-59 | 926 | 24 | N | | |
| CALPA1 | 12-833-264 | 927 | 24 | N | | |
| CALPA1 | 12-833-279 | 928 | 24 | N | | |
| CALPA1 | 12-833-280 | 929 | 24 | N | | |
| CALPA1 | 12-833-373 | 930 | 24 | N | | |
| CALPA1 | 12-834-183 | 931 | 24 | N | | |
| CALPA1 | 12-835-54 | 932 | 24 | N | | |
| CALPA1 | 12-836-134 | 933 | 24 | N | | |
| CALPA1 | 12-836-237 | 934 | 24 | N | | |
| CALPA1 | 12-836-238 | 935 | 24 | N | | |
| CALPA1 | 12-836-257 | 936 | 24 | N | | |
| CALPA1 | 12-836-275 | 937 | 24 | N | | |
| CALPA1 | 12-838-179 | 938 | 24 | N | | |
| CALPA1 | 12-839-397 | 939 | 24 | N | | |
| CALPA1 | 12-840-47 | 940 | 24 | N | | |
| CALPA1 | 12-840-77 | 941 | 24 | N | | |
| CALPA1 | 12-841-445 | 942 | 24 | N | | |
| CALPA1 | 12-842-215 | 943 | 24 | N | | |
| CALPA1 | 12-842-447 | 944 | 24 | N | | |
| CALPA1 | 12-844-167 | 945 | 24 | N | | |
| CALPA1 | 12-845-364 | 946 | 24 | N | | |
| CALPA1 | 12-846-209 | 947 | 24 | N | | |

TABLE 7B-continued

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| CALPA1 | 12-847-123 | 948 | 24 | N | | |
| CALPA1 | 12-849-242 | 949 | 24 | N | | |
| CYP2J2 | 10-336-58 | 950 | 24 | N | | |
| CYP2J2 | 10-336-137 | 951 | 24 | N | | |
| CYP2J2 | 10-336-232 | 952 | 24 | N | | |
| CYP2J2 | 12-102-104 | 953 | 24 | N | | |
| CYP2J2 | 12-102-111 | 954 | 24 | N | | |
| CYP2J2 | 12-102-275 | 955 | 24 | N | | |
| CYP2J2 | 12-103-202 | 956 | 24 | Y | C | 14.3 |
| CYP2J2 | 12-103-214 | 957 | 24 | N | | |
| CYP2J2 | 12-104-351 | 958 | 24 | Y | T | 27.4 |
| CYP2J2 | 12-105-435 | 959 | 24 | N | | |
| CYP2J2 | 12-109-149 | 960 | 24 | Y | A | 8.51 |
| CYP2J2 | 12-109-197 | 961 | 24 | N | | |
| CYP2J2 | 12-109-209 | 962 | 24 | N | | |
| CYP2J2 | 12-109-284 | 963 | 24 | N | | |
| CYP2J2 | 12-113-276 | 964 | 24 | Y | G | 31.2 |
| CYP2J2 | 12-115-57 | 965 | 24 | Y | G | 8.87 |
| CYP2J2 | 12-119-26 | 966 | 24 | Y | G | 29.8 |
| COX1 | 12-347-308 | 967 | 24 | N | | |
| COX1 | 12-354-334 | 968 | 24 | Y | C/C | |
| COX1 | 12-357-140 | 969 | 24 | Y | C | 7.14 |
| COX1 | 12-361-320 | 970 | 24 | Y | G | 18.3 |
| COX1 | 12-361-388 | 971 | 24 | Y | A | 18.5 |
| COX1 | 12-365-251 | 972 | 24 | Y | C | 18.8 |
| COX1 | 12-374-261 | 973 | 24 | Y | T | 21.3 |
| COX1 | 10-308-116 | 974 | 24 | N | | |
| COX1 | 10-311-274 | 975 | 24 | N | | |
| COX1 | 10-314-76 | 976 | 24 | N | | |
| COX1 | 10-306-265 | 977 | 24 | N | | |
| COX2 | 10-52-386 | 978 | 24 | N | | |
| COX2 | 10-62-240 | 979 | 24 | Y | C | 12.23 |
| COX2 | 10-65-276 | 980 | 24 | Y | | |
| COX2 | 10-67-42 | 981 | 24 | N | | |
| COX2 | 10-67-340 | 982 | 24 | Y | | |
| COX2 | 10-55-265 | 983 | 24 | Y | C | 40.9 |
| COX2 | 10-57-278 | 984 | 24 | Y | | |
| COX2 | 10-59-176 | 985 | 24 | Y | | |
| COX2 | 10-60-114 | 986 | 24 | N | | |
| PGDS | 10-27-176 | 987 | 24 | Y | A | 5.32 |
| PGDS | 10-28-242 | 988 | 24 | Y | | |
| PGDS | 10-30-349 | 989 | 24 | Y | A/A | |
| PGDS | 10-181-42 | 990 | 24 | Y | C | 30.2 |
| PGDS | 10-181-372 | 991 | 24 | Y | C | 26.3 |
| PGDS | 10-183-260 | 992 | 24 | N | | |
| PG15OH | 10-475-163 | 993 | 24 | N | | |
| PG15OH | 12-884-203 | 994 | 24 | Y | T | 29.7 |
| PG15OH | 10-479-266 | 995 | 24 | N | | |
| PG15OH | 10-479-350 | 996 | 24 | N | | |
| PG15OH | 10-479-394 | 997 | 24 | N | | |
| PG15OH | 10-482-145 | 998 | 24 | N | | |
| PG15OH | 12-854-64 | 999 | 24 | N | | |
| PG15OH | 12-854-472 | 1000 | 24 | N | | |
| PG15OH | 12-855-194 | 1001 | 24 | N | | |
| PG15OH | 12-855-288 | 1002 | 24 | N | | |
| PG15OH | 12-855-423 | 1003 | 24 | N | | |
| PG15OH | 12-857-25 | 1004 | 24 | N | | |
| PG15OH | 12-858-346 | 1005 | 24 | Y | T | 37.2 |
| PG15OH | 12-858-443 | 1006 | 24 | N | | |
| PG15OH | 12-860-388 | 1007 | 24 | N | | |
| PG15OH | 12-861-270 | 1008 | 24 | N | | |
| PG15OH | 12-862-349 | 1009 | 24 | N | | |
| PG15OH | 12-862-365 | 1010 | 24 | N | | |
| PG15OH | 12-862-452 | 1011 | 24 | N | | |
| PG15OH | 12-866-423 | 1012 | 24 | Y | C | 46.2 |
| PG15OH | 12-867-47 | 1013 | 24 | N | | |
| PG15OH | 12-868-181 | 1014 | 24 | N | | |
| PG15OH | 12-868-198 | 1015 | 24 | N | | |
| PG15OH | 12-868-282 | 1016 | 24 | N | | |
| PG15OH | 12-869-128 | 1017 | 24 | N | | |
| PG15OH | 12-870-491 | 1018 | 24 | N | | |
| PG15OH | 12-872-52 | 1019 | 24 | N | | |

TABLE 7B-continued

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| PG15OH | 12-872-293 | 1020 | 24 | N | | |
| PG15OH | 12-873-185 | 1021 | 24 | N | | |
| PG15OH | 12-873-319 | 1022 | 24 | N | | |
| PG15OH | 12-875-248 | 1023 | 24 | Y | G | 28.8 |
| PG15OH | 12-876-265 | 1024 | 24 | N | | |
| PG15OH | 12-876-280 | 1025 | 24 | N | | |
| PG15OH | 12-876-454 | 1026 | 24 | N | | |
| PG15OH | 12-877-59 | 1027 | 24 | N | | |
| PG15OH | 12-877-69 | 1028 | 24 | N | | |
| PG15OH | 12-877-79 | 1029 | 24 | N | | |
| PG15OH | 12-878-153 | 1030 | 24 | N | | |
| PG15OH | 12-878-419 | 1031 | 24 | N | | |
| PG15OH | 12-879-67 | 1032 | 24 | N | | |
| PG15OH | 12-879-439 | 1033 | 24 | N | | |
| PG15OH | 12-881-210 | 1034 | 24 | N | | |
| PG15OH | 12-881-389 | 1035 | 24 | N | | |
| PG15OH | 12-883-273 | 1036 | 24 | N | | |
| PG15OH | 12-885-196 | 1037 | 24 | N | | |
| PG15OH | 12-885-333 | 1038 | 24 | N | | |
| PG15OH | 12-885-407 | 1039 | 24 | N | | |
| PG15OH | 12-885-410 | 1040 | 24 | N | | |
| PG15OH | 12-886-195 | 1041 | 24 | Y | A | 21.1 |
| PG15OH | 12-886-348 | 1042 | 24 | N | | |
| PG15OH | 12-887-201 | 1043 | 24 | N | | |
| PG15OH | 12-887-467 | 1044 | 24 | N | | |
| PG15OH | 12-888-98 | 1045 | 24 | N | | |
| PG15OH | 12-888-203 | 1046 | 24 | Y | G | 38.3 |
| PG15OH | 12-888-315 | 1047 | 24 | N | | |
| PG15OH | 12-889-518 | 1048 | 24 | N | | |
| PG15OH | 12-894-266 | 1049 | 24 | N | | |
| PG15OH | 12-895-391 | 1050 | 24 | Y | C | 34.6 |
| PG15OH | 12-896-140 | 1051 | 24 | N | | |
| PG15OH | 12-897-115 | 1052 | 24 | N | | |
| PG15OH | 12-897-225 | 1053 | 24 | N | | |
| PG15OH | 12-898-49 | 1054 | 24 | N | | |
| CYP8 | 12-164-119 | 1055 | 24 | Y | C | 11.8 |
| CYP8 | 12-168-84 | 1056 | 24 | Y | T | 20.1 |
| CYP8 | 12-168-365 | 1057 | 24 | N | | |
| CYP8 | 12-170-299 | 1058 | 24 | Y | T | 6.52 |
| CYP8 | 12-171-360 | 1059 | 24 | Y | T | 8.70 |
| CYP8 | 12-173-59 | 1060 | 24 | Y | G | 26.0 |
| CYP8 | 12-175-214 | 1061 | 24 | Y | A | 10.1 |
| CYP8 | 12-177-183 | 1062 | 24 | Y | G | 25.4 |
| CYP8 | 12-177-366 | 1063 | 24 | N | | |
| TAX2 | 10-128-45 | 1064 | 24 | Y | T/T | |
| TAX2 | 10-128-63 | 1065 | 24 | N | | |
| TAX2 | 10-123-177 | 1066 | 24 | N | | |
| TAX2 | 10-123-402 | 1067 | 24 | N | | |
| TAX2 | 10-120-137 | 1068 | 24 | Y | A | 1.60 |
| TAX2 | 10-120-141 | 1069 | 24 | Y | A | 3.09 |
| TAX2 | 10-179-39 | 1070 | 24 | N | | |
| TAX2 | 10-180-65 | 1071 | 24 | Y | C | 44.7 |
| TAX2 | 10-179-257 | 1072 | 24 | Y | | |
| 15-LOA | 10-43-124 | 1073 | 24 | N | | |
| 15-LOA | 10-43-134 | 1074 | 24 | N | | |
| 15-LOA | 10-43-193 | 1075 | 24 | N | | |
| 15-LOA | 10-43-195 | 1076 | 24 | N | | |
| 15-LOA | 10-43-233 | 1077 | 24 | N | | |
| 15-LOA | 10-43-138 | 1078 | 24 | Y | | |
| 15-LOA | 10-46-372 | 1079 | 24 | Y | T | 2.43 |
| 15-LOA | 10-46-36 | 1080 | 24 | N | | |
| 15-LOA | 10-47-103 | 1081 | 24 | Y | | |
| 15-LOA | 10-47-125 | 1082 | 24 | Y | T | 5.68 |
| 15-LOA | 10-48-184 | 1083 | 24 | Y | T | 28.0 |
| 15-LOA | 10-48-381 | 1084 | 24 | Y | T | 31.4 |
| 15-LOA | 10-49-33 | 1085 | 24 | Y | T | 14.3 |
| 15-LOA | 10-39-148 | 1086 | 24 | Y | G | 14.5 |
| 15-LOA | 10-40-222 | 1087 | 24 | Y | A | 47.6 |
| 15-LOA | 10-40-252 | 1088 | 24 | N | | |
| 15-LOA | 10-42-354 | 1089 | 24 | Y | | |
| 15-LOA | 10-154-42 | 1090 | 24 | N | | |
| 15-LOA | 10-154-156 | 1091 | 24 | Y | T | 24.2 |

TABLE 7B-continued

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| 15-LOA | 10-154-226 | 1092 | 24 | N | | |
| 15-LOB | 12-776-259 | 1093 | 24 | N | | |
| 5-LO | 10-384-109 | 1094 | 24 | N | | |
| 5-LO | 12-296-388 | 1095 | 24 | Y | G | 37.6 |
| 5-LO | 10-388-379 | 1096 | 24 | N | | |
| 5-LO | 10-389-116 | 1097 | 24 | N | | |
| 5-LO | 10-389-349 | 1098 | 24 | N | | |
| 5-LO | 10-391-94 | 1099 | 24 | N | | |
| 5-LO | 12-277-147 | 1100 | 24 | Y | T | 44.9 |
| 5-LO | 12-278-413 | 1101 | 24 | Y | A | 33.9 |
| 5-LO | 12-288-190 | 1102 | 24 | N | | |
| 5-LO | 12-289-35 | 1103 | 24 | N | | |
| 5-LO | 12-296-119 | 1104 | 24 | N | | |
| 5-LO | 12-297-291 | 1105 | 24 | N | | |
| 5-LO | 12-298-105 | 1106 | 24 | N | | |
| 5-LO | 12-300-126 | 1107 | 24 | N | | |
| 5-LO | 12-300-410 | 1108 | 24 | N | | |
| 5-LO | 12-301-379 | 1109 | 24 | N | | |
| 5-LO | 12-302-264 | 1110 | 24 | N | | |
| 5-LO | 12-309-405 | 1111 | 24 | N | | |
| 5-LO | 12-310-105 | 1112 | 24 | N | | |
| 5-LO | 12-314-453 | 1113 | 24 | Y | A | 18.8 |
| 5-LO | 12-316-292 | 1114 | 24 | Y | C | 40.8 |
| LTA4H | 10-281-314 | 1115 | 24 | N | | |
| LTA4H | 10-268-381 | 1116 | 24 | N | | |
| LTA4H | 12-54-297 | 1117 | 24 | Y | C | 9.34 |
| LTA4H | 10-276-407 | 1118 | 24 | N | | |
| LTA4H | 12-44-50 | 1119 | 24 | Y | A | 25.9 |
| LTA4H | 12-44-67 | 1120 | 24 | N | | |
| LTA4H | 12-45-145 | 1121 | 24 | N | | |
| LTA4H | 12-45-166 | 1122 | 24 | N | | |
| LTA4H | 12-45-305 | 1123 | 24 | N | | |
| LTA4H | 12-46-92 | 1124 | 24 | Y | G | 31.9 |
| LTA4H | 12-47-132 | 1125 | 24 | Y | C | 4.84 |
| LTA4H | 12-47-61 | 1126 | 24 | N | | |
| LTA4H | 12-48-100 | 1127 | 24 | N | | |
| LTA4H | 12-48-323 | 1128 | 24 | N | | |
| LTA4H | 12-48-369 | 1129 | 24 | N | | |
| LTA4H | 12-48-37 | 1130 | 24 | N | | |
| LTA4H | 12-49-131 | 1131 | 24 | Y | A | 40.1 |
| LTA4H | 12-49-53 | 1132 | 24 | N | | |
| LTA4H | 12-49-64 | 1133 | 24 | N | | |
| LTA4H | 12-51-234 | 1134 | 24 | Y | A | 43.3 |
| LTA4H | 12-51-253 | 1135 | 24 | N | | |
| LTA4H | 12-51-370 | 1136 | 24 | N | | |
| LTA4H | 12-52-400 | 1137 | 24 | N | | |
| LTA4H | 12-57-192 | 1138 | 24 | Y | T | 41.2 |
| LTA4H | 12-57-221 | 1139 | 24 | Y | T | 4.40 |
| LTA4H | 12-57-510 | 1140 | 24 | N | | |
| LTB4H2 | 10-1-139 | 1141 | 24 | Y | G | 36.3 |
| LTB4H2 | 10-1-212 | 1142 | 24 | Y | T | 16.3 |
| LTB4H2 | 10-1-241 | 1143 | 24 | Y | A | 5.84 |
| LTB4H2 | 10-9-143 | 1144 | 24 | Y | | |
| LTB4H2 | 10-9-185 | 1145 | 24 | Y | T/T | |
| LTB4H2 | 10-9-264 | 1146 | 24 | Y | | |
| LTB4H2 | 10-11-22 | 1147 | 24 | N | | |
| LTB4H2 | 10-13-152 | 1148 | 24 | Y | T | 20.8 |
| LTB4H2 | 10-13-256 | 1149 | 24 | Y | | |
| LTB4H2 | 10-13-282 | 1150 | 24 | Y | C | 25.0 |
| LTB4H2 | 10-15-281 | 1151 | 24 | N | | |
| LTB4H2 | 10-17-142 | 1152 | 24 | Y | C/C | |
| LTB4H2 | 10-18-302 | 1153 | 24 | N | | |
| LTB4H2 | 10-23-331 | 1154 | 24 | N | | |
| LTB4H2 | 10-25-152 | 1155 | 24 | Y | | |
| LTB4H2 | 10-25-258 | 1156 | 24 | N | | |
| LTB4H2 | 10-3-103 | 1157 | 24 | Y | T | 47.7 |
| LTB4H2 | 10-3-144 | 1158 | 24 | Y | | |
| LTB4H2 | 10-3-275 | 1159 | 24 | Y | | |
| LTB4H2 | 10-5-227 | 1160 | 24 | Y | A | 28.1 |
| LTB4H2 | 10-7-155 | 1161 | 24 | Y | T | 30.4 |
| LTB4H2 | 10-7-383 | 1162 | 24 | N | | |
| LTB4H2 | 10-7-98 | 1163 | 24 | N | | |

TABLE 7B-continued

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| LTB412OH | 12-561-270 | 1164 | 24 | Y | T | 35.2 |
| LTB412OH | 12-563-87 | 1165 | 24 | Y | C | 28.0 |
| LTB412OH | 12-564-64 | 1166 | 24 | Y | T | 36.0 |
| LTB412OH | 12-564-214 | 1167 | 24 | N | | |
| LTB412OH | 12-568-207 | 1168 | 24 | N | | |
| LTB412OH | 12-568-365 | 1169 | 24 | N | | |
| LTB412OH | 12-568-367 | 1170 | 24 | N | | |
| LTB412OH | 12-571-337 | 1171 | 24 | Y | G | 17.9 |
| LTB412OH | 12-573-378 | 1172 | 24 | Y | A | 6.91 |
| LTB412OH | 10-294-256 | 1173 | 24 | N | | |
| LTB412OH | 10-294-304 | 1174 | 24 | N | | |
| LTB412OH | 10-295-201 | 1175 | 24 | N | | |
| LTB412OH | 10-296-80 | 1176 | 24 | N | | |
| LTB412OH | 10-296-373 | 1177 | 24 | N | | |
| LTB412OH | 10-298-122 | 1178 | 24 | N | | |
| LTB412OH | 10-298-158 | 1179 | 24 | N | | |
| LTB412OH | 10-300-49 | 1180 | 24 | N | | |
| LTB412OH | 10-300-185 | 1181 | 24 | N | | |
| LTB4H3 | 10-10-328 | 1182 | 24 | Y | A | 12.5 |
| LTB4H3 | 10-12-52 | 1183 | 24 | N | | |
| LTB4H3 | 10-14-46 | 1184 | 24 | Y | T | 39.3 |
| LTB4H3 | 10-19-358 | 1185 | 24 | Y | | |
| LTB4H3 | 10-20-111 | 1186 | 24 | Y | A | 15.8 |
| LTB4H3 | 10-20-274 | 1187 | 24 | Y | A/A | |
| LTB4H3 | 10-24-90 | 1188 | 24 | Y | C | 19.2 |
| LTB4H3 | 10-24-204 | 1189 | 24 | Y | A | 25.0 |
| LTB4H3 | 10-24-221 | 1190 | 24 | N | | |
| LTB4H3 | 10-24-234 | 1191 | 24 | Y | A | 36.1 |
| LTB4H3 | 10-24-288 | 1192 | 24 | N | | |
| LTB4H3 | 10-24-311 | 1193 | 24 | N | | |
| LTB4H3 | 10-26-289 | 1194 | 24 | N | | |
| LTB4H3 | 10-8-39 | 1195 | 24 | Y | | |
| LTB4H3 | 10-8-120 | 1196 | 24 | N | | |
| LTB4H3 | 10-8-154 | 1197 | 24 | N | | |
| LTB4H3 | 10-8-101 | 1198 | 24 | Y | | |
| LTB4H3 | 10-8-86 | 1199 | 24 | Y | | |
| LTB4H3 | 10-8-92 | 1200 | 24 | N | | |
| LTB4H3 | 10-8-94 | 1201 | 24 | N | | |
| LTB4R | 12-61-472 | 1202 | 24 | N | | |
| LTB4R | 12-63-402 | 1203 | 24 | N | | |
| LTB4R | 12-63-74 | 1204 | 24 | N | | |
| LTB4R | 12-64-271 | 1205 | 24 | Y | C | 28.6 |
| LTB4R | 12-65-98 | 1206 | 24 | N | | |
| LTB4R | 12-70-147 | 1207 | 24 | Y | C | 11.5 |
| LTB4R | 12-70-397 | 1208 | 24 | Y | T | 39.7 |
| LTB4R | 12-71-320 | 1209 | 24 | Y | A | 4.49 |
| LTB4R | 12-73-150 | 1210 | 24 | N | | |
| LTB4R | 12-73-49 | 1211 | 24 | Y | A | 43.3 |
| LTB4R | 12-73-56 | 1212 | 24 | N | | |
| LTB4R | 12-74-38 | 1213 | 24 | Y | C | 44.1 |
| LTB4R | 12-76-238 | 1214 | 24 | Y | T | 20.6 |
| LTB4R | 12-77-217 | 1215 | 24 | N | | |
| LTB4R | 12-77-478 | 1216 | 24 | Y | A | 4.40 |
| LTB4R | 12-80-114 | 1217 | 24 | N | | |
| LTB4R | 12-80-233 | 1218 | 24 | Y | C | 4.55 |
| LTB4R | 12-82-250 | 1219 | 24 | N | | |
| LTC4 | 10-176-85 | 1220 | 24 | Y | T | 0.54 |
| LTC4 | 10-176-51 | 1221 | 24 | N | | |
| LTC4 | 10-176-207 | 1222 | 24 | N | | |
| LTC4 | 10-176-397 | 1223 | 24 | Y | A | 1.63 |
| LTC4 | 10-177-219 | 1224 | 24 | Y | C | 29.0 |
| 12-LO | 12-214-85 | 1225 | 24 | N | | |
| 12-LO | 12-215-272 | 1226 | 24 | N | | |
| 12-LO | 12-221-163 | 1227 | 24 | N | | |
| 12-LO | 12-225-82 | 1228 | 24 | N | | |
| cPLA$_2$ | 10-234-179 | 1229 | 24 | Y | Deletion AA | 32.6 |
| cPLA$_2$ | 10-235-272 | 1230 | 24 | N | | |
| ANX1 | 10-251-342 | 1231 | 24 | N | | |
| ANX2 | 10-395-367 | 1232 | 24 | N | | |
| ANX2 | 12-730-58 | 1233 | 24 | N | | |
| ANX2 | 12-735-208 | 1234 | 24 | Y | Deletion | 21.5 |

TABLE 7B-continued

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE FREQUENCY % | |
|---|---|---|---|---|---|---|
| ANX2 | 12-739-22 | 1235 | 24 | Y | Insertion G | 23.4 |
| ANX3 | 12-540-363 | 1236 | 24 | N | | |
| ANX3 | 12-550-206 | 1237 | 24 | N | | |
| CAL2 | 12-207-410 | 1238 | 24 | N | | |
| CAL3 | 10-171-254 | 1239 | 24 | N | | |
| CALPA1 | 12-94-110 | 1240 | 24 | Y | Deletion AATT | 32.5 |
| CALPA1 | 12-834-290 | 1241 | 24 | N | | |
| COX2 | 10-55-115 | 1242 | 24 | Y | Deletion TTATA | 3.01 |
| PG15OH | 12-857-122 | 1243 | 24 | N | | |
| PG15OH | 12-872-175 | 1244 | 24 | N | | |
| PG15OH | 12-882-40 | 1245 | 24 | N | | |
| PG15OH | 12-888-234 | 1246 | 24 | N | | |
| 5-LO | 12-278-353 | 1247 | 24 | N | | |
| 5-LO | 12-283-386 | 1248 | 24 | N | | |
| LTA4H | 12-44-181 | 1249 | 24 | N | | |
| ANX3 | 10-370-132 | 1250 | 24 | N | | |
| ANX3 | 10-370-254 | 1251 | 24 | N | | |
| 15PGDHB | 10-485-256 | 1252 | 24 | N | | |
| 15PGDHB | 10-485-257 | 1253 | 24 | N | | |
| 15PGDHB | 10-474-320 | 1254 | 24 | N | | |
| 5LO | 10-387-371 | 1255 | 24 | N | | |
| LTB412OH | 12-570-239 | 1256 | 24 | N | | |
| LTB412OH | 12-570-344 | 1257 | 24 | N | | |
| LTB412OH | 12-570-393 | 1258 | 24 | N | | |
| LTB412OH | 12-570-421 | 1259 | 24 | N | | |
| LTB412OH | 12-570-62 | 1260 | 24 | N | | |
| LTB4H3 | 10-4-144 | 1261 | 24 | N | | |
| LTB4H3 | 10-4-161 | 1262 | 24 | N | | |
| LTB4H3 | 10-4-270 | 1263 | 24 | N | | |
| LTB4H3 | 10-4-340 | 1264 | 24 | N | | |
| LTB4H3 | 10-4-369 | 1265 | 24 | N | | |
| LTB4H3 | 10-4-420 | 1266 | 24 | N | | |
| LTB4H2 | 10-13-396 | 1267 | 24 | N | | |
| 12-LO | 10-509-284 | 1268 | 24 | N | | |
| 12-LO | 10-509-295 | 1269 | 24 | N | | |
| 12-LO | 10-339-124 | 1270 | 24 | N | | |
| 12-LO | 10-340-112 | 1271 | 24 | N | | |
| 12-LO | 10-340-130 | 1272 | 24 | N | | |
| 12-LO | 10-340-238 | 1273 | 24 | N | | |
| 12-LO | 10-342-301 | 1274 | 24 | N | | |
| 12-LO | 10-342-373 | 1275 | 24 | N | | |
| 12-LO | 10-343-231 | 1276 | 24 | N | | |
| 12-LO | 10-343-278 | 1277 | 24 | N | | |
| 12-LO | 10-346-141 | 1278 | 24 | N | G/G | |
| 12-LO | 10-346-23 | 1279 | 24 | N | | |
| 12-LO | 10-346-263 | 1280 | 24 | N | | |
| 12-LO | 10-346-305 | 1281 | 24 | N | | |
| 12-LO | 10-349-216 | 1282 | 24 | N | | |
| 12-LO | 10-350-332 | 1283 | 24 | N | | |
| 12-LO | 10-350-72 | 1284 | 24 | N | | |
| 12-LO | 10-507-170 | 1285 | 24 | N | | |
| 12-LO | 10-507-321 | 1286 | 24 | N | | |
| 12-LO | 10-507-353 | 1287 | 24 | N | | |
| 12-LO | 10-507-364 | 1288 | 24 | N | | |
| 12-LO | 10-507-405 | 1289 | 24 | N | | |
| 12-LO | 10-508-191 | 1290 | 24 | N | | |
| 12-LO | 10-508-245 | 1291 | 24 | N | | |
| 12-LO | 10-510-173 | 1292 | 24 | N | | |
| 12-LO | 10-511-337 | 1293 | 24 | N | | |
| 12-LO | 10-512-36 | 1294 | 24 | Y | C | 39.4 |
| 12-LO | 10-511-62 | 1295 | 24 | N | | |
| 12-LO | 10-512-318 | 1296 | 24 | N | | |
| 12-LO | 10-513-250 | 1297 | 24 | N | | |
| 12-LO | 10-513-262 | 1298 | 24 | N | | |
| 12-LO | 10-513-352 | 1299 | 24 | N | | |
| 12-LO | 10-513-365 | 1300 | 24 | N | | |

TABLE 7B-continued

List of all of the eicosanoid-related biallelic markers (47mers)

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE FREQUENCY % |
|---|---|---|---|---|---|
| FLAP | 10-517-100 | 1301 | 24 | N | |
| FLAP | 10-518-125 | 1302 | 24 | N | |
| FLAP | 10-518-194 | 1303 | 24 | N | |
| FLAP | 10-522-71 | 1304 | 24 | N | |

TABLE 8

| SEQ ID NO. | BIALLELIC MARKER ID | 1$^{ST}$ ALLELE | 2$^{ND}$ ALLELE | POSITION RANGE OF PREFERRED SEQUENCE |
|---|---|---|---|---|
| 1 | 10-253-118 | A | G | [1–955] |
| 2 | 10-253-298 | G | C | [1–840] |
| 3 | 10-253-315 | C | T | [1–823] |
| 4 | 10-499-155 | A | G | [1–556], [898–955] |
| 5 | 10-520-256 | C | T | [1–384], [726–955] |
| 6 | 10-500-258 | G | T | [1–311], [653–955] |
| 7 | 10-500-410 | A | G | [1–160], [502–955] |
| 8 | 10-503-159 | G | T | [143–160], [388–408], [447–955] |
| 9 | 10-504-172 | A | T | [1–85], [124–792] |
| 10 | 10-504-243 | A | C | [1–15], [54–722] |
| 19 | 10-35-358 | G | C | [555–842] |
| 23 | 12-628-306 | G | A | [1–868], [904–955] |
| 24 | 12-628-311 | T | C | [1–873], [909–955] |
| 25 | 12-629-241 | G | C | [1–17], [247–658], [705–787], [882–955] |
| 27 | 10-343-339 | G | T | [487–506], [733–904] |
| 28 | 10-347-74 | A | G | [1–134], [240–487], [784–956] |
| 35 | 10-348-391 | A | G | [351–552], [682–776] |
| 40 | 10-349-368 | C | T | [416–525] |
| 44 | 12-196-119 | C | T | [1–469] |
| 45 | 12-197-244 | C | T | [153–206] |
| 48 | 12-208-35 | A | T | [1–346], [453–507] |
| 52 | 12-215-467 | G | T | [1–161], [254–499] |
| 53 | 12-216-421 | A | G | [1–486] |
| 54 | 12-219-230 | A | G | [1–485] |
| 55 | 12-219-256 | C | T | [1–485] |
| 56 | 12-220-48 | G | A | [1–577], [883–956] |
| 57 | 12-221-302 | A | C | [1–64], [265–286] |
| 58 | 12-223-179 | A | G | [1–468] |
| 59 | 12-223-207 | C | T | [1–468] |
| 60 | 12-225-541 | C | T | [1–60], [368–598] |
| 61 | 12-226-167 | G | C | [1–255], [344–508] |
| 62 | 12-226-458 | C | T | [1–255], [344–508] |
| 63 | 12-229-332 | G | C | [1–456] |
| 64 | 12-229-351 | G | C | [1–456] |
| 65 | 12-230-364 | C | T | [1–420] |
| 66 | 12-231-100 | C | T | [1–490] |
| 67 | 12-231-148 | C | T | [1–490] |
| 68 | 12-231-266 | C | T | [1–490] |
| 72 | 10-239-368 | C | T | [1–144], [373–618] |
| 73 | 10-223-30 | G | C | [1–653], [729–1001] |
| 74 | 10-223-72 | A | G | [1–612], [688–1001] |
| 75 | 10-223-130 | A | T | [1–555], [631–1001] |
| 76 | 10-223-262 | A | G | [1–424], [500–1001] |
| 77 | 10-223-392 | A | G | [1–294], [370–1001] |
| 78 | 10-224-341 | C | T | [137–176], [428–563], [920–1001] |
| 82 | 10-251-128 | A | G | [202–240], [373–415], [464–518], [581–777] |
| 84 | 12-387-32 | A | G | [1–396], [464–1001] |
| 85 | 10-242-316 | G | C | [1–350], [418–1000] |
| 86 | 10-245-412 | A | G | [367–701] |
| 87 | 12-378-171 | T | C | [1–731] |
| 88 | 12-378-228 | G | A | [1–788] |
| 89 | 12-378-450 | T | A | [1–1001] |
| 90 | 12-379-65 | A | G | [1–1001] |
| 91 | 12-382-204 | A | G | [1–1001] |
| 92 | 12-383-117 | A | G | [1–37], [246–317], [383–1001] |
| 93 | 12-383-170 | A | G | [193–264], [330–1001] |
| 94 | 12-383-268 | G | T | [95–166], [232–1001] |
| 98 | 12-385-427 | G | T | [257–826] |
| 99 | 12-386-155 | G | T | [272–682], [823–943] |

TABLE 8-continued

| SEQ ID NO. | BIALLELIC MARKER ID | 1ST ALLELE | 2ND ALLELE | POSITION RANGE OF PREFERRED SEQUENCE |
|---|---|---|---|---|
| 100 | 12-386-24 | C | T | [272–682] |
| 101 | 12-387-177 | C | T | [1–251], [319–1001] |
| 102 | 12-389-431 | C | T | [1–386], [470–583], [644–996] |
| 103 | 12-391-366 | C | T | [293–1001] |
| 104 | 12-394-85 | A | C | [1–103], [184–266], [345–1001] |
| 105 | 12-395-382 | A | G | [1–885] |
| 108 | 12-401-378 | A | G | [1–880] |
| 109 | 12-402-126 | C | T | [99–823] |
| 110 | 12-404-265 | A | G | [1–261], [314–501], [715–733], [782–817] |
| 111 | 12-406-52 | C | T | [136–952], [984–1001] |
| 112 | 12-406-409 | A | G | [1–595], [627–1001] |
| 113 | 12-407-217 | G | C | [247–673] |
| 114 | 12-407-399 | A | T | [1–491], [955–1001] |
| 115 | 12-408-355 | G | C | [80–907] |
| 116 | 12-409-221 | A | C | [1–500] |
| 117 | 12-410-301 | C | T | [111–986] |
| 118 | 10-395-101 | A | G | [1–529], [633–1001] |
| 119 | 10-395-124 | A | G | [1–539], [611–1001] |
| 120 | 10-395-155 | A | T | [1–509], [581–1001] |
| 121 | 10-395-294 | C | T | [1–371], [443–858] |
| 122 | 10-396-100 | A | G | [1–506], [635–776], [952–1001] |
| 124 | 10-399-178 | A | G | [1–142], [178–514], [632–1001] |
| 125 | 10-400-369 | A | T | [1–285], [385–513], [555–844], [878–941] |
| 126 | 10-392-20 | A | G | [75–203], [245–534], [568–631], [746–849], [898–997] |
| 127 | 10-392-103 | A | G | [1–552], [663–770], [819–1001] |
| 128 | 10-392-324 | G | C | [1–331], [442–549], [598–891], [977–1001] |
| 129 | 10-393-27 | G | C | [1–76], [187–294], [343–636], [722–1001] |
| 130 | 10-393-324 | A | G | [1–340], [423–1001] |
| 131 | 12-727-237 | A | G | [513–1001] |
| 132 | 12-728-224 | A | G | [352–507], [661–772], [862–1001] |
| 133 | 12-730-142 | A | G | [1–1001] |
| 134 | 12-730-193 | A | G | [1–1001] |
| 135 | 12-731-60 | C | T | [97–665], [711–729], [898–1001] |
| 136 | 12-731-119 | C | T | [1–606], [652–670], [839–1001] |
| 137 | 12-731-137 | G | T | [1–588], [634–652], [821–1001] |
| 138 | 12-731-146 | A | C | [1–579], [625–643], [812–1001] |
| 139 | 12-731-398 | C | T | [1–327], [373–391], [560–743], [823–1001] |
| 140 | 12-732-113 | A | G | [58–1001] |
| 141 | 12-732-164 | A | G | [1–1001] |
| 142 | 12-732-165 | G | C | [1–1001] |
| 143 | 12-732-445 | C | T | [1–935], [975–1001] |
| 144 | 12-734-201 | T | C | [161–1001] |
| 145 | 12-735-42 | G | A | [1–343], [374–566], [656–682], [731–961] |
| 146 | 12-736-363 | G | A | [1–1001] |
| 147 | 12-737-69 | T | C | [1–739] |
| 148 | 12-737-296 | G | A | [1–960] |
| 149 | 12-738-429 | G | A | [1–205], [411–1001] |
| 150 | 12-740-112 | A | G | [1–26], [144–616], [743–1001] |
| 151 | 12-740-118 | C | T | [1–20], [138–610], [737–1001] |
| 152 | 12-741-265 | G | A | [1–1001] |
| 153 | 12-741-327 | T | A | [1–1001] |
| 154 | 12-741-376 | G | A | [1–1001] |
| 155 | 12-745-30 | G | A | [1–1001] |
| 156 | 12-745-75 | T | C | [1–1001] |
| 157 | 12-745-343 | T | G | [1–1001] |
| 158 | 12-745-350 | C | A | [1–1001] |
| 159 | 12-746-320 | C | T | [1–1001] |
| 160 | 12-747-181 | C | T | [1–1001] |
| 161 | 12-747-302 | C | T | [1–1001] |
| 164 | 12-752-37 | G | A | [1–1003] |
| 165 | 12-752-85 | C | G | [1–1001] |
| 166 | 12-752-196 | T | C | [1–62], [108–1001] |
| 167 | 12-752-484 | T | C | [396–1001] |
| 168 | 12-753-139 | C | T | [1–1001] |
| 169 | 12-753-376 | C | T | [1–778], [855–1001] |
| 170 | 12-754-172 | C | T | [1–1001] |
| 171 | 12-754-218 | C | T | [1–1001] |
| 172 | 12-754-328 | G | C | [1–1001] |
| 173 | 12-754-396 | G | T | [1–1001] |
| 174 | 12-755-280 | G | C | [1–1001] |
| 176 | 12-758-257 | A | C | [1–1001] |
| 177 | 12-758-374 | A | C | [1–1001] |
| 178 | 12-758-424 | A | G | [1–1001] |
| 179 | 12-761-23 | G | A | [1–177], [253–701] |
| 180 | 12-761-178 | G | A | [1–292], [368–1001] |
| 181 | 12-764-329 | G | A | [1–1001] |

TABLE 8-continued

| SEQ ID NO. | BIALLELIC MARKER ID | 1ST ALLELE | 2ND ALLELE | POSITION RANGE OF PREFERRED SEQUENCE |
|---|---|---|---|---|
| 182 | 12-764-377 | G | A | [1–1001] |
| 183 | 12-765-168 | G | A | [1–906] |
| 184 | 12-765-504 | T | C | [1–1002] |
| 190 | 12-513-389 | C | T | [1–1001] |
| 191 | 12-513-494 | G | C | [1–999] |
| 192 | 12-515-394 | A | T | [77–950] |
| 193 | 12-516-97 | C | T | [1–744], [798–1001] |
| 194 | 12-520-287 | A | T | [179–468], [506–885] |
| 195 | 12-520-323 | A | G | [143–432], [470–849] |
| 196 | 12-523-179 | G | A | [1–291], [344–1001] |
| 197 | 12-523-270 | G | A | [1–382], [435–1001] |
| 198 | 12-527-367 | T | A | [1–496], [595–1001] |
| 199 | 12-529-376 | T | C | [279–1001] |
| 200 | 12-529-489 | T | C | [1–37], [391–1001] |
| 201 | 12-530-134 | A | T | [1–94], [166–224], [316–803] |
| 202 | 12-530-393 | C | T | [57–544], [766–1001] |
| 203 | 12-531-173 | C | T | [1–231], [414–735], [789–1001] |
| 204 | 12-539-441 | C | T | [1–1001] |
| 205 | 12-543-78 | G | A | [1–836] |
| 206 | 12-543-79 | C | G | [1–837] |
| 207 | 12-546-235 | C | T | [1–403], [492–1001] |
| 208 | 12-549-287 | T | C | [149–494] |
| 209 | 12-550-287 | A | G | [304–1001] |
| 210 | 12-552-175 | G | A | [1–750], [831–883] |
| 211 | 12-554-330 | G | T | [1–1001] |
| 212 | 12-556-312 | A | C | [1–1001] |
| 213 | 12-556-443 | C | T | [1–1001] |
| 214 | 12-558-205 | C | G | [1–1001] |
| 215 | 12-558-238 | T | C | [1–1001] |
| 216 | 12-558-305 | T | A | [1–1001] |
| 217 | 12-769-39 | G | T | [1–292], [593–624], [690–1001] |
| 218 | 12-769-430 | C | T | [202–233], [299–633] |
| 219 | 12-770-73 | G | A | [1–716] |
| 220 | 12-772-200 | G | A | [1–732], [788–1001] |
| 221 | 12-772-254 | T | C | [1–786], [842–1001] |
| 233 | 10-166-362 | A | C | |
| 250 | 12-86-79 | G | A | [70–653], [748–1001] |
| 252 | 12-89-369 | G | C | [1–51], [102–1001] |
| 253 | 12-89-91 | A | G | [1–329], [380–1000] |
| 254 | 12-94-210 | C | T | [573–588] |
| 255 | 12-94-516 | A | T | [287–302] |
| 256 | 12-96-64 | C | A | [1–630], [936–1001] |
| 257 | 12-97-83 | A | C | [1–20], [543–649], [719–916], [964–1001] |
| 258 | 12-99-296 | G | A | [1–210], [305–522], [904–1001] |
| 259 | 12-100-266 | T | C | [504–545], [927–949] |
| 260 | 12-811-174 | T | C | [1–945] |
| 261 | 12-815-94 | A | G | [1–1001] |
| 262 | 12-815-383 | A | G | [1–1001] |
| 263 | 12-815-384 | G | C | [1–1001] |
| 264 | 12-815-391 | C | T | [1–1001] |
| 268 | 12-821-62 | T | G | [1–294], [376–437], [621–887] |
| 269 | 12-821-483 | T | G | [1–48], [460–510], [664–715], [797–858] |
| 270 | 12-825-173 | A | C | [1–34], [522–1001] |
| 273 | 12-833-264 | T | A | [1–86], [216–446], [558–1001] |
| 274 | 12-833-279 | G | A | [1–101], [231–461], [573–1001] |
| 275 | 12-833-280 | T | C | [1–102], [232–462], [574–1001] |
| 276 | 12-833-373 | G | A | [1–195], [325–555], [667–1001] |
| 277 | 12-834-183 | A | G | [295–990] |
| 278 | 12-835-54 | A | G | [1–1001] |
| 279 | 12-836-134 | C | T | [84–249], [354–587], [633–1001] |
| 280 | 12-836-237 | A | G | [1–147], [252–945] |
| 281 | 12-836-238 | A | T | [1–123], [228–919] |
| 282 | 12-836-257 | A | G | [1–123], [228–919] |
| 283 | 12-836-275 | A | C | [1–108], [213–904] |
| 284 | 12-838-179 | A | G | [1–519], [718–1001] |
| 285 | 12-839-397 | G | A | [1–43], [110–1001] |
| 286 | 12-840-47 | C | G | [1–553], [659–1001] |
| 287 | 12-840-77 | T | C | [1–583], [689–1001] |
| 288 | 12-841-445 | G | C | [1–502] |
| 291 | 12-844-167 | T | C | [186–1001] |
| 292 | 12-845-364 | G | A | [1–849] |
| 293 | 12-846-209 | A | T | [1–817] |
| 294 | 12-847-123 | A | G | [1–1001] |
| 295 | 12-849-242 | C | A | [1–27], [490–658] |
| 298 | 10-336-232 | A | G | [507–1001] |
| 299 | 12-102-104 | A | G | [1–630], [712–790] |

TABLE 8-continued

| SEQ ID NO. | BIALLELIC MARKER ID | 1ST ALLELE | 2ND ALLELE | POSITION RANGE OF PREFERRED SEQUENCE |
|---|---|---|---|---|
| 300 | 12-102-111 | A | G | [1–630], [712–790] |
| 301 | 12-102-275 | A | G | [1–581], [663–741], [834–851], [891–1001] |
| 302 | 12-103-202 | C | T | [188–767] |
| 303 | 12-103-214 | A | G | [176–755] |
| 304 | 12-104-351 | T | G | [1–20], [336–402], [438–511], [911–935] |
| 305 | 12-105-435 | A | G | [1–147], [492–924] |
| 306 | 12-109-149 | A | G | [1–59], [289–607] |
| 307 | 12-109-197 | A | G | [1–59], [289–607] |
| 308 | 12-109-209 | A | G | [1–59], [289–607] |
| 309 | 12-109-284 | A | G | [1–59], [289–607] |
| 310 | 12-113-276 | T | C | [1–1001] |
| 311 | 12-115-57 | A | G | [507–1001] |
| 312 | 12-119-26 | T | C | [1–569] |
| 314 | 12-354-334 | G | A | [1–750] |
| 315 | 12-357-140 | C | T | [1–1001] |
| 316 | 12-361-320 | G | T | [1–201], [268–1001] |
| 317 | 12-361-388 | A | G | [1–133], [200–1001] |
| 318 | 12-365-251 | G | C | [1–41], [132–151], [232–622], [688–933] |
| 319 | 12-374-261 | G | A | [249–1001] |
| 321 | 10-311-274 | C | T | [125–305], [472–878] |
| 322 | 10-314-76 | C | T | [1–224], [290–535], [803–1001] |
| 335 | 10-30-349 | A | G | |
| 340 | 12-884-203 | C | T | [1–349], [464–1001] |
| 342 | 10-479-350 | C | T | [1–280], [446–1001] |
| 343 | 10-479-394 | A | G | [1–236], [402–1001] |
| 345 | 12-854-64 | A | G | [1–1001] |
| 346 | 12-854-472 | G | T | [1–1001] |
| 347 | 12-855-194 | T | G | [1–1001] |
| 348 | 12-855-288 | T | C | [1–1001] |
| 349 | 12-855-423 | T | G | [1–1001] |
| 350 | 12-857-25 | C | T | [221–985] |
| 351 | 12-858-346 | T | C | [1–1001] |
| 352 | 12-858-443 | G | A | [1–1001] |
| 353 | 12-860-388 | G | A | [1–30], [157–628], [831–1001] |
| 354 | 12-861-270 | C | T | [1–780] |
| 355 | 12-862-349 | A | G | [78–1001] |
| 356 | 12-862-365 | C | T | [62–1001] |
| 357 | 12-862-452 | G | T | [1–1000] |
| 358 | 12-866-423 | C | T | [1–434], [521–1001] |
| 359 | 12-867-47 | C | T | [81–769] |
| 360 | 12-868-181 | A | G | [306–1001] |
| 361 | 12-868-198 | A | G | [289–1001] |
| 362 | 12-868-282 | C | T | [205–1001] |
| 363 | 12-869-128 | A | C | [1–128], [908–1001] |
| 365 | 12-872-52 | A | G | [436–1001] |
| 366 | 12-872-293 | A | G | [185–1001] |
| 367 | 12-873-185 | T | C | [114–257], [288–377], [572–1001] |
| 368 | 12-873-319 | T | A | [1–139], [248–391], [422–511], [706–1001] |
| 369 | 12-875-248 | T | C | [1–408], [525–1001] |
| 370 | 12-876-265 | T | A | [1–1001] |
| 371 | 12-876-280 | C | G | [1–1001] |
| 372 | 12-876-454 | G | A | [1–1001] |
| 373 | 12-877-59 | C | T | [329–1001] |
| 374 | 12-877-69 | G | T | [319–1001] |
| 375 | 12-877-79 | C | T | [309–1001] |
| 376 | 12-878-153 | C | T | [207–937] |
| 377 | 12-878-419 | G | T | [1–629], [734–929] |
| 378 | 12-879-67 | G | C | [1–200], [261–460], [527–1001] |
| 379 | 12-879-439 | A | G | [1–89], [156–796] |
| 380 | 12-881-210 | A | G | [1–1001] |
| 381 | 12-881-389 | G | T | [1–841] |
| 382 | 12-883-273 | G | C | [1–56], [96–1001] |
| 383 | 12-885-196 | T | C | [1–1001] |
| 384 | 12-885-333 | C | G | [1–1001] |
| 385 | 12-885-407 | T | C | [1–1001] |
| 386 | 12-885-410 | C | G | [1–1001] |
| 387 | 12-886-195 | T | C | [1–815], [867–1001] |
| 388 | 12-886-348 | T | C | [1–968] |
| 389 | 12-887-201 | G | A | [1–59], [181–1001] |
| 390 | 12-887-467 | T | C | [295–325], [447–1001] |
| 391 | 12-888-98 | G | A | [1–717], [916–1001] |
| 392 | 12-888-203 | C | A | [1–822] |
| 393 | 12-888-315 | T | G | [1–1001] |
| 394 | 12-889-518 | G | A | [1–89], [280–320], [441–1001] |
| 395 | 12-894-266 | T | C | [1–1001] |
| 396 | 12-895-391 | G | A | [148–1001] |

TABLE 8-continued

| SEQ ID NO. | BIALLELIC MARKER ID | 1ST ALLELE | 2ND ALLELE | POSITION RANGE OF PREFERRED SEQUENCE |
|---|---|---|---|---|
| 397 | 12-896-140 | T | A | [60–76], [126–1001] |
| 398 | 12-897-115 | T | C | [259–557] |
| 399 | 12-897-225 | G | A | [369–667] |
| 400 | 12-898-49 | G | A | [1–283], [372–781] |
| 401 | 12-164-119 | T | G | [1–646], [979–1001] |
| 403 | 12-168-365 | C | G | [1–600] |
| 407 | 12-175-214 | A | G | [1–154], [227–317], [391–660], [747–1001] |
| 408 | 12-177-183 | C | G | [1–837], [975–1001] |
| 409 | 12-177-366 | C | A | [1–1001] |
| 427 | 10-47-103 | A | C | |
| 428 | 10-47-125 | A | T | |
| 433 | 10-40-222 | A | G | |
| 434 | 10-40-252 | C | T | |
| 442 | 10-388-379 | C | T | [1–202], [383–1001] |
| 443 | 10-389-116 | A | G | [1–538], [693–1001] |
| 444 | 10-389-349 | C | T | [1–305], [460–1001] |
| 445 | 10-391-94 | A | G | [1–259], [301–575], [691–928] |
| 446 | 12-277-147 | A | T | [1–693] |
| 447 | 12-278-413 | A | G | [1–151], [365–733], [775–1001] |
| 448 | 12-288-190 | G | A | [1–701] |
| 449 | 12-289-35 | A | G | [1–791], [946–1001] |
| 450 | 12-296-119 | A | G | [451–550] |
| 451 | 12-297-291 | C | T | [1–1001] |
| 452 | 12-298-105 | G | A | [1–162], [348–1001] |
| 453 | 12-300-126 | A | G | [1–782] |
| 454 | 12-300-410 | A | C | [1–415], [447–498] |
| 455 | 12-301-379 | A | T | [1–627], [932–1001] |
| 456 | 12-302-264 | G | A | [1–1001] |
| 458 | 12-310-105 | G | C | [293–1001] |
| 459 | 12-314-453 | A | T | [1–392], [439–558], [643–799] |
| 460 | 12-316-292 | C | T | [1–460] |
| 461 | 10-281-314 | G | T | [1–282], [453–832], [921–1001] |
| 462 | 10-268-381 | C | T | [1–197], [383–895] |
| 463 | 12-54-297 | C | T | [97–326], [404–518], [658–1001] |
| 464 | 10-276-407 | C | T | [1–97], [510–615], [954–1001] |
| 465 | 12-44-50 | T | C | [220–534], [918–1001] |
| 466 | 12-44-67 | T | C | [237–551], [935–1001] |
| 469 | 12-45-305 | C | T | [1–63], [488–816] |
| 470 | 12-46-92 | A | G | [83–1001] |
| 471 | 12-47-132 | C | T | [1–184], [457–685], [799–871], [987–1001] |
| 472 | 12-47-61 | C | T | [72–255], [528–756], [870–942] |
| 473 | 12-48-100 | A | G | [1–1001] |
| 474 | 12-48-323 | A | G | [1–747] |
| 475 | 12-48-369 | C | T | [1–682] |
| 476 | 12-48-37 | C | T | [1–1001] |
| 477 | 12-49-131 | T | C | [1–609], [677–749], [920–1001] |
| 478 | 12-49-53 | G | A | [1–531 ], [599–671], [842–1001] |
| 479 | 12-49-64 | G | A | [1–542], [610–682], [853–1001] |
| 480 | 12-51-234 | T | C | [1–47], [182–541], [919–1001] |
| 481 | 12-51-253 | C | A | [1–66], [201–560], [938–1001] |
| 482 | 12-51-370 | G | A | [1–182], [317–676] |
| 483 | 12-52-400 | G | A | [1–100], [404–1001] |
| 484 | 12-57-192 | G | A | [1–168], [286–752] |
| 485 | 12-57-221 | G | A | [1–197], [315–781] |
| 486 | 12-57-510 | C | A | [1–163], [251–486], [604–1010] |
| 494 | 10-13-152 | C | T | |
| 510 | 12-561-270 | C | T | [188–203], [496–642], [697–738] |
| 511 | 12-563-87 | C | T | [1–929] |
| 512 | 12-564-64 | G | T | [1–213], [381–1001] |
| 513 | 12-564-214 | C | T | [1–64], [232–1001] |
| 514 | 12-568-207 | G | T | [424–513], [613–1001] |
| 515 | 12-568-365 | G | T | [266–355], [455–1001] |
| 516 | 12-568-367 | G | T | [264–353], [453–1001] |
| 517 | 12-571-337 | G | C | [1–53], [327–897] |
| 518 | 12-573-378 | A | G | [1–335], [437–910] |
| 519 | 10-294-256 | G | C | [1–53], [327–897] |
| 520 | 10-294-304 | G | C | [279–849], [942–1001] |
| 522 | 10-296-80 | A | G | [359–397], [531–906] |
| 523 | 10-296-373 | A | G | [60–105], [239–623], [924–1001] |
| 524 | 10-298-122 | C | T | [1–565], [737–873] |
| 525 | 10-298-158 | A | G | [1–529], [701–837] |
| 526 | 10-300-49 | A | G | [285–643], [808–854] |
| 527 | 10-300-185 | C | T | [92–507], [672–718], [976–1001] |
| 549 | 12-63-402 | A | G | [1–472] |
| 550 | 12-63-74 | A | G | [1–472] |
| 551 | 12-64-271 | C | T | [1–787] |

TABLE 8-continued

| SEQ ID NO. | BIALLELIC MARKER ID | 1ST ALLELE | 2ND ALLELE | POSITION RANGE OF PREFERRED SEQUENCE |
|---|---|---|---|---|
| 552 | 12-65-98 | C | T | [112–272], [334–864] |
| 553 | 12-70-147 | A | C | [1–211], [491–1001] |
| 554 | 12-70-397 | C | T | [241-1001] |
| 555 | 12-71-320 | A | G | [1–1001] |
| 556 | 12-73-150 | C | T | [1–140], [275–607], [646–821] |
| 557 | 12-73-49 | A | G | [1–240], [375–707], [746–921] |
| 558 | 12-73-56 | A | T | [1–233], [368–700], [739–914] |
| 559 | 12-74-38 | G | A | [1–1001] |
| 561 | 12-77-217 | C | T | [1–822] |
| 562 | 12-77-478 | A | G | [1–562] |
| 563 | 12-80-114 | T | C | [1–1001] |
| 564 | 12-80-233 | G | A | [1–1001] |
| 565 | 12-82-250 | A | T | [404–454] |
| 571 | 12-214-85 | CCTAT | — | [1–101], [259–305] |
| 572 | 12-215-272 | T | — | [1–161], [254–499] |
| 573 | 12-221-163 | GTCCTCA | T | [1–64], [265–286] |
| 574 | 12-225-82 | T | — | [1–60], [368–598] |
| 577 | 10-251-342 | GG | C | [1–56], [156–301], [364–560] |
| 578 | 10-395-367 | A | — | [1–263], [367–717], [764–783] |
| 579 | 12-730-58 | ACAA | — | [162–251], [287–321], [517–767] |
| 580 | 12-735-208 | — | Deletion | [1–689], [779–805], [854–1002] |
| 581 | 12-739-22 | G | — | [1–39], [386–640], [791–1002] |
| 582 | 12-540-363 | T | — | [1–1002] |
| 583 | 12-550-206 | T | — | [380–1002] |
| 587 | 12-834-290 | G | — | [196–1002] |
| 589 | 12-857-122 | CTCT | — | [145–1002] |
| 590 | 12-872-175 | T | — | [1–41], [310–1102] |
| 592 | 12-888-234 | C | — | [1–850], [950–1002] |
| 593 | 12-278-353 | A | — | [1–208], [422–790], [832–1001] |
| 595 | 12-44-181 | C | — | [308–622], [983–1002] |
| 602 | 12-570-239 | T | C | [386–671], [724–727], [947–1001] |
| 603 | 12-570-344 | T | C | [1–51], [491–601], [727–776], [829–832] |
| 619 | 10-340-238 | A | G | [231–310], [487–601] |
| 620 | 10-342-301 | Insertion | — | [432–576], [605–609], [676–722] |
| 621 | 10-342-373 | C | T | [360–504], [533–537], [604–650], [930–1001] |
| 625 | 10-346-23 | A | G | [1–144], [233–274][305–347], [478–592], [696–945] |
| 626 | 10-346-263 | G | C | [1–37], [68–110], [241–355], [459–708] |
| 627 | 10-346-305 | C | T | [1–68], [199–313], [417–666], [961–1001] |
| 629 | 10-350-332 | C | T | [1–913] |
| 630 | 10-350-72 | C | T | [1–1001] |
| 632 | 10-507-321 | A | C | [1–308], [440–462], [552–652], [711–1000] |
| 633 | 10-507-353 | C | T | [1–276], [408–430], [520–620], [679–1000] |
| 634 | 10-507-364 | C | T | [1–265], [397–609], [668–1000] |
| 635 | 10-507-405 | C | T | [1–224], [356–378], [468–568], [627–1000] |
| 636 | 10-508-191 | C | T | [1–403], [442–444], [491–640], [942–1000] |
| 637 | 10-508-245 | C | T | [1–349], [388–390], [463–586], [888–1000] |
| 638 | 10-510-173 | ATTTA | TTTTT | [243–380], [411–546] |
| 647 | 10-517-100 | G | C | [1–1000] |
| 648 | 10-518-125 | G | T | [1–1000] |
| 649 | 10-518-194 | A | G | [1–1000] |
| 650 | 10-522-71 | A | G | [1–806], [844–863], [911–920], [950–1000] |

TABLE 9

| SEQ ID NO. | BIALLELIC MARKER ID | ORIGINAL ALLELE | ALTERNATIVE ALLELE |
|---|---|---|---|
| 11 | 10-204-326 | G | A |
| 12 | 10-32-357 | C | A |
| 13 | 10-33-175 | C | T |
| 14 | 10-33-211 | C | T |
| 15 | 10-33-234 | A | C |
| 16 | 10-33-270 | G | A |
| 17 | 10-33-327 | T | C |
| 18 | 10-34-290 | G | T |
| 20 | 10-35-390 | C | T |
| 21 | 10-36-164 | G | A |
| 26 | 12-206-366 | T | C |
| 29 | 10-347-111 | G | C |
| 30 | 10-347-165 | C | T |
| 33 | 10-347-271 | A | T |
| 34 | 10-347-348 | G | A |
| 36 | 10-349-47 | T | C |
| 38 | 10-349-142 | C | G |
| 41 | 10-339-32 | C | T |
| 43 | 10-341-319 | C | T |
| 46 | 12-198-128 | G | A |
| 47 | 12-206-81 | G | A |
| 49 | 12-214-129 | C | T |
| 50 | 12-214-151 | G | C |
| 51 | 12-214-360 | G | C |
| 69 | 10-231-23 | G | A |
| 70 | 10-233-386 | A | G |
| 79 | 10-227-282 | A | G |
| 80 | 10-240-241 | A | G |
| 83 | 10-252-209 | G | A |
| 95 | 12-384-336 | C | T |

TABLE 9-continued

| SEQ ID NO. | BIALLELIC MARKER ID | ORIGINAL ALLELE | ALTERNATIVE ALLELE |
|---|---|---|---|
| 96 | 12-384-451 | G | C |
| 97 | 12-385-123 | C | T |
| 106 | 12-400-217 | A | G |
| 107 | 12-400-280 | A | G |
| 162 | 12-749-240 | G | A |
| 163 | 12-749-255 | G | T |
| 175 | 12-757-384 | T | C |
| 185 | 10-372-279 | T | C |
| 186 | 10-375-136 | T | C |
| 187 | 10-376-281 | A | T |
| 188 | 10-369-392 | C | T |
| 222 | 10-87-73 | C | T |
| 223 | 10-87-74 | A | T |
| 224 | 10-87-80 | A | G |
| 225 | 10-87-140 | C | T |
| 226 | 10-88-81 | T | C |
| 227 | 10-89-41 | G | A |
| 228 | 10-90-35 | G | A |
| 229 | 10-91-274 | T | G |
| 231 | 10-94-197 | G | A |
| 232 | 10-94-198 | T | G |
| 234 | 10-207-386 | C | G |
| 235 | 10-207-409 | G | C |
| 236 | 10-118-307 | G | A |
| 237 | 10-173-247 | G | A |
| 238 | 10-173-294 | A | G |
| 239 | 10-173-347 | C | T |
| 240 | 10-103-104 | C | T |
| 241 | 10-103-323 | T | C |
| 242 | 10-103-402 | C | T |
| 243 | 10-106-98 | C | A |
| 246 | 10-168-160 | T | C |
| 247 | 10-168-206 | C | A |
| 248 | 10-168-284 | T | A |
| 249 | 10-169-318 | C | A |
| 251 | 12-88-393 | A | C |
| 265 | 12-817-214 | G | A |
| 266 | 12-817-355 | T | C |
| 267 | 12-819-437 | A | G |
| 271 | 12-826-312 | G | A |
| 272 | 12-831-59 | G | C |
| 289 | 12-842-215 | T | C |
| 290 | 12-842-447 | A | G |
| 297 | 10-336-137 | T | A |
| 313 | 12-347-308 | G | A |
| 320 | 10-308-116 | C | T |
| 326 | 10-65-276 | G | A |
| 327 | 10-67-42 | A | T |
| 328 | 10-67-340 | T | C |
| 331 | 10-59-176 | C | T |
| 332 | 10-60-114 | A | G |
| 334 | 10-28-242 | G | A |
| 336 | 10-181-42 | C | T |
| 337 | 10-181-372 | C | T |
| 338 | 10-183-260 | C | G |
| 341 | 10-479-266 | G | A |
| 364 | 12-870-491 | A | G |
| 402 | 12-168-84 | A | C |
| 404 | 12-170-299 | G | A |
| 405 | 12-171-360 | C | T |
| 406 | 12-173-59 | A | G |
| 410 | 10-128-45 | T | C |
| 411 | 10-128-63 | A | G |
| 412 | 10-123-177 | G | A |
| 414 | 10-120-137 | G | A |
| 415 | 10-120-141 | C | A |
| 425 | 10-46-372 | C | T |
| 429 | 10-48-184 | C | T |
| 430 | 10-48-381 | C | T |
| 431 | 10-49-33 | C | T |
| 432 | 10-39-148 | A | G |
| 435 | 10-42-354 | T | C |
| 436 | 10-154-42 | C | T |
| 437 | 10-154-156 | C | T |
| 438 | 10-154-226 | G | A |
| 439 | 12-776-259 | A | G |
| 440 | 10-384-109 | C | T |
| 441 | 12-296-388 | A | G |
| 457 | 12-309-405 | A | G |
| 467 | 12-45-145 | A | G |
| 468 | 12-45-166 | G | A |
| 487 | 10-1-139 | G | T |
| 488 | 10-1-212 | G | T |
| 489 | 10-1-241 | C | A |
| 491 | 10-9-185 | T | C |
| 492 | 10-9-264 | C | G |
| 493 | 10-11-22 | T | C |
| 495 | 10-13-256 | C | T |
| 496 | 10-13-282 | T | C |
| 497 | 10-15-281 | T | G |
| 498 | 10-17-142 | C | T |
| 499 | 10-18-302 | C | T |
| 500 | 10-23-331 | G | A |
| 501 | 10-25-152 | T | C |
| 502 | 10-25-258 | C | T |
| 503 | 10-3-103 | C | T |
| 504 | 10-3-144 | T | C |
| 505 | 10-3-275 | G | T |
| 506 | 10-5-227 | A | C |
| 507 | 10-7-155 | T | C |
| 508 | 10-7-383 | C | T |
| 509 | 10-7-98 | G | C |
| 533 | 10-20-274 | A | G |
| 534 | 10-24-90 | A | C |
| 536 | 10-24-221 | G | T |
| 546 | 10-8-92 | T | C |
| 547 | 10-8-94 | C | T |
| 548 | 12-61-472 | C | T |
| 560 | 12-76-238 | G | T |
| 566 | 10-176-85 | C | T |
| 567 | 10-176-51 | C | T |
| 568 | 10-176-207 | G | T |
| 569 | 10-176-397 | C | A |
| 570 | 10-177-219 | A | C |
| 575 | 10-234-179 | AA | — |
| 576 | 10-235-272 | T | — |
| 584 | 10-207-410 | — | C |
| 585 | 10-171-254 | GG | — |
| 586 | 12-94-110 | — | AATT |
| 588 | 10-55-115 | TTATA | — |
| 591 | 12-882-40 | A | — |
| 594 | 12-283-386 | T | — |
| 598 | 10-485-256 | A | G |
| 599 | 10-485-257 | T | C |
| 600 | 10-474-320 | Insertion A | — |
| 601 | 10-387-371 | T | C |
| 604 | 12-570-393 | C | T |
| 605 | 12-570-421 | T | G |
| 606 | 12-570-62 | Insertion TG | — |
| 607 | 10-4-144 | C | A |
| 608 | 10-4-161 | A | C |
| 609 | 10-4-270 | G | C |
| 610 | 10-4-340 | A | G |
| 611 | 10-4-369 | C | T |
| 612 | 10-4-420 | G | T |
| 613 | 10-13-396 | Insertion AAT | — |
| 614 | 10-509-284 | C | T |
| 616 | 10-339-124 | C | T |
| 617 | 10-340-112 | C | A |
| 618 | 10-340-130 | T | A |
| 622 | 10-343-231 | Insertion C | — |
| 623 | 10-343-278 | C | T |
| 624 | 10-346-141 | G | A |
| 628 | 10-349-216 | Insertion CTG | — |
| 631 | 10-507-170 | A | G |
| 639 | 10-511-337 | Deletion | — |
| 640 | 10-512-36 | G | C |
| 641 | 10-511-62 | C | T |
| 642 | 10-512-318 | G | A |

TABLE 9-continued

| SEQ ID NO. | BIALLELIC MARKER ID | ORIGINAL ALLELE | ALTERNATIVE ALLELE |
|---|---|---|---|
| 643 | 10-513-250 | G | A |
| 644 | 10-513-262 | T | C |
| 645 | 10-513-352 | G | A |
| 646 | 10-513-365 | G | A |

TABLE 10

| SEQ ID NO. | BIALLELIC MARKER ID | 1ST ALLELE | 2ND ALLELE |
|---|---|---|---|
| 22 | 10-498-192 | A | G |
| 31 | 10-347-203 | A | G |
| 32 | 10-347-220 | A | G |
| 37 | 10-349-97 | A | G |
| 39 | 10-349-224 | G | T |
| 42 | 10-341-116 | A | G |
| 81 | 10-249-185 | A | G |
| 123 | 10-397-201 | G | T |
| 189 | 10-371-257 | A | C |
| 230 | 10-93-133 | C | T |
| 244 | 10-106-288 | C | T |
| 245 | 10-106-378 | C | T |
| 296 | 10-336-58 | C | T |
| 323 | 10-306-265 | A | G |
| 324 | 10-52-386 | C | T |
| 325 | 10-62-240 | G | C |
| 329 | 10-55-265 | C | T |
| 330 | 10-57-278 | C | T |
| 333 | 10-27-176 | A | G |
| 339 | 10-475-163 | A | G |
| 344 | 10-482-145 | A | G |
| 413 | 10-123-402 | A | G |
| 416 | 10-179-39 | C | T |
| 417 | 10-180-65 | G | C |
| 418 | 10-179-257 | G | T |
| 426 | 10-46-36 | T | A |
| 521 | 10-295-201 | G | T |
| 528 | 10-10-328 | G | A |
| 529 | 10-12-52 | C | T |
| 530 | 10-14-46 | C | T |
| 532 | 10-20-111 | A | C |
| 535 | 10-24-204 | A | G |
| 537 | 10-24-234 | A | G |
| 538 | 10-24-288 | A | G |
| 539 | 10-24-311 | G | C |
| 541 | 10-8-39 | A | C |
| 542 | 10-8-120 | A | G |
| 543 | 10-8-154 | G | C |
| 544 | 10-8-101 | A | T |
| 545 | 10-8-86 | C | T |
| 596 | 10-370-132 | C | T |
| 597 | 10-370-254 | C | T |
| 615 | 10-509-295 | Insertion and Deletion | |

TABLE 11

Sequences that are useful for designing some of the primers and probes of the invention

| SEQ ID NO. | POSITION RANGE OF NOVEL SEQUENCE |
|---|---|
| 26 | [569–588], [815–956] |
| 29 | [1–97], [203–450], [747–956] |
| 30 | [1–43], [149–396], [693–956] |
| 31 | [111–358], [655–956] |
| 32 | [94–341], [638–956] |
| 33 | [44–291], [588–956] |
| 34 | [1–214], [511–844] |
| 36 | [734–843] |

TABLE 11-continued

Sequences that are useful for designing some of the primers and probes of the invention

| SEQ ID NO. | POSITION RANGE OF NOVEL SEQUENCE |
|---|---|
| 37 | [684–793] |
| 38 | [639–748] |
| 39 | [557–666] |
| 41 | [217–319], [721–781] |
| 42 | [1–96], [276–387], [881–956] |
| 43 | [72–184], [678–820] |
| 46 | [1–56], [193–400] |
| 47 | [855–874] |
| 49 | [1–101], [259–305] |
| 50 | [1–101], [259–305] |
| 51 | [1–101], [259–305] |
| 79 | [1–311], [512–1001] |
| 80 | [709–1001] |
| 81 | [1–231], [723–741] |
| 83 | [291–476] |
| 95 | [1–138], [532–662], [970–1001] |
| 96 | [59–254], [648–778], [918–1001] |
| 97 | [318–757] |
| 106 | [88–182], [309–461], [798–843] |
| 107 | [1–119], [246–398], [735–780] |
| 123 | [1–449], [568–1001] |
| 162 | [264–407], [801–833] |
| 163 | [249–392], [786–818] |
| 175 | [1–419] |
| 185 | [267–360], [549–599], [651–807], [851–1001] |
| 186 | [1–459], [691–1001] |
| 187 | [1–311], [557–1001] |
| 188 | [1–155], [662–1001] |
| 189 | [1–39], [554–1001] |
| 251 | [746–1001] |
| 265 | [315–445], [873–1001] |
| 266 | [174–304], [732–1001] |
| 271 | [1–173], [572–844], [884–917] |
| 272 | [1–75], [556–576] |
| 289 | [1–191] |
| 290 | [160–421] |
| 296 | [1–151], [681–1001] |
| 297 | [1–72], [602–1001] |
| 313 | [1–319] |
| 320 | [592–1001] |
| 339 | [1–24], [804–1001] |
| 341 | [1–364], [530–1001] |
| 364 | [1–270], [554–1001] |
| 402 | [1–319] |
| 404 | [1–319], [767–830] |
| 405 | [1–222], [639–1001] |
| 439 | [1–73], [608–900] |
| 440 | [1–40], [732–1001] |
| 441 | [182–281] |
| 457 | [1–315], [838–1001] |
| 467 | [1–222], [647–1001] |
| 468 | [1–201], [626–954] |
| 521 | [1–138], [281–412], [529–880] |
| 548 | [60–80] |
| 560 | [539–810] |
| 588 | [406–418] |
| 591 | [150–320], [777–824], [864–1002] |
| 594 | [300–450] |
| 596 | [196–237], [920–1001] |
| 597 | [74–115], [798–1001] |
| 598 | [557–1001] |
| 599 | [556–1001] |
| 600 | [256–267], [669–670], [833–835] |
| 604 | [1–100], [540–650], [776–825], [878–881], [969–985] |
| 605 | [1–128], [568–678], [804–853], [906–909], [997–1001] |
| 606 | [210–320], [446–495], [548–551], [771–1001] |
| 607 | [1–54] |
| 608 | [1–54] |
| 609 | [1–54] |
| 610 | [1–54] |
| 611 | [1–54] |
| 612 | [1–54] |
| 613 | [1–30], [138–179] |

TABLE 11-continued

Sequences that are useful for designing some of the primers and probes of the invention

| SEQ ID NO. | POSITION RANGE OF NOVEL SEQUENCE |
|---|---|
| 614 | [725–814] |
| 615 | [714–803] |
| 616 | [1–252], [634–713], [890–1001] |
| 617 | [106–155], [357–436], [613–727] |
| 618 | [88–137], [339–418], [595–709] |
| 622 | [138–178], [592–638], [863–1001] |
| 623 | [91–131], [545–591], [816–1001] |
| 624 | [1–29], [118–159], [190–232], [363–477], [581–830] |
| 628 | [587–698] |
| 631 | [199–459], [591–613], [703–803], [862–1000] |
| 641 | [1–159], [190–325] |
| 646 | [1–20] |

TABLE 12

Microsequencing primers

| SEQ ID NO. | POSITION RANGE OF MICROSEQUENCING PRIMERS | COMPLEMENTARY POSITION RANGE OF MICROSEQUENCING PRIMERS |
|---|---|---|
| 1 | 458–477 | 479–498 |
| 2 | 459–477* | 479–498 |
| 3 | 458–477 | 479–498 |
| 4 | 458–477 | 479–498 |
| 5 | 458–477 | 479–498 |
| 6 | 458–477 | 479–498 |
| 7 | 458–477 | 479–498 |
| 8 | 458–477 | 479–498 |
| 9 | 458–477 | 479–498 |
| 10 | 458–477 | 479–498 |
| 11 | 458–477 | 479–497* |
| 12 | 459–477* | 479–498 |
| 13 | 459–477* | 479–498 |
| 14 | 458–477 | 479–498 |
| 15 | 459–477* | 479–498 |
| 16 | 459–477* | 479–498 |
| 17 | 459–477* | 479–498 |
| 18 | 458–477 | 479–498 |
| 19 | 459–477* | 479–498 |
| 20 | 459–477* | 479–498 |
| 21 | 458–477 | 479–497* |
| 22 | 458–477 | 479–498 |
| 23 | 458–477 | 479–497* |
| 24 | 458–477 | 479–498 |
| 25 | 459–477* | 479–498 |
| 26 | 459–477* | 479–498 |
| 27 | 458–477 | 479–498 |
| 28 | 458–477 | 479–498 |
| 29 | 458–477 | 479–498 |
| 30 | 458–477 | 479–498 |
| 31 | 459–477* | 479–498 |
| 32 | 458–477 | 479–497* |
| 33 | 458–477 | 479–498 |
| 34 | 458–477 | 479–498 |
| 35 | 458–477 | 479–498 |
| 36 | 458–477 | 479–498 |
| 37 | 458–477 | 479–497* |
| 38 | 458–477 | 479–498 |
| 39 | 458–477 | 479–497* |
| 40 | 458–477 | 479–498 |
| 41 | 458–477 | 479–498 |
| 42 | 458–477 | 479–497* |
| 43 | 458–477 | 479–498 |
| 44 | 100–118* | 120–139 |
| 45 | 224–242* | 244–263 |
| 46 | 108–127 | 129–148 |
| 47 | 458–477 | 479–498 |
| 48 | 16–34* | 36–55 |
| 49 | 110–128* | 130–149 |

TABLE 12-continued

Microsequencing primers

| SEQ ID NO. | POSITION RANGE OF MICROSEQUENCING PRIMERS | COMPLEMENTARY POSITION RANGE OF MICROSEQUENCING PRIMERS |
|---|---|---|
| 50 | 131–150 | 152–171 |
| 51 | 338–357 | 359–378 |
| 52 | 446–465 | 467–486 |
| 53 | 398–417 | 419–437* |
| 54 | 209–228 | 230–248* |
| 55 | 235–254 | 256–275 |
| 56 | 458–477 | 479–498 |
| 57 | 282–301 | 303–322 |
| 58 | 159–178 | 180–199 |
| 59 | 188–206* | 208–227 |
| 60 | 521–539* | 541–560 |
| 61 | 147–165* | 167–185* |
| 62 | 435–454 | 456–475 |
| 63 | 312–331 | 333–352 |
| 64 | 331–350 | 352–371 |
| 65 | 344–363 | 365–384 |
| 66 | 79–98 | 100–119 |
| 67 | 127–146 | 148–167 |
| 68 | 245–264 | 266–285 |
| 69 | 480–499 | 501–519* |
| 70 | 481–500 | 502–520* |
| 72 | 481–500 | 502–521 |
| 73 | 482–500* | 502–521 |
| 74 | 481–500 | 502–521 |
| 75 | 481–500 | 502–521 |
| 76 | 481–500 | 502–521 |
| 77 | 481–500 | 502–521 |
| 78 | 481–500 | 502–521 |
| 79 | 481–500 | 502–520* |
| 80 | 481–500 | 502–521 |
| 81 | 481–500 | 502–521 |
| 82 | 481–500 | 502–521 |
| 83 | 481–500 | 502–521 |
| 84 | 482–500* | 502–521 |
| 85 | 480–499 | 501–520 |
| 86 | 481–500 | 502–521 |
| 87 | 481–500 | 502–521 |
| 88 | 481–500 | 502–521 |
| 89 | 481–500 | 502–521 |
| 90 | 481–500 | 502–521 |
| 91 | 482–500* | 502–521 |
| 92 | 481–500 | 502–521 |
| 93 | 481–500 | 502–521 |
| 94 | 481–500 | 502–521 |
| 95 | 481–500 | 502–521 |
| 96 | 481–500 | 502–521 |
| 97 | 238–257 | 259–278 |
| 98 | 481–500 | 502–521 |
| 99 | 423–442 | 444–462* |
| 100 | 293–312 | 314–333 |
| 101 | 481–500 | 502–520* |
| 102 | 481–500 | 502–521 |
| 103 | 481–500 | 502–521 |
| 104 | 481–500 | 502–521 |
| 105 | 365–384 | 386–405 |
| 106 | 482–500* | 502–521 |
| 107 | 481–500 | 502–521 |
| 108 | 360–379 | 381–400 |
| 109 | 303–322 | 324–343 |
| 110 | 297–316 | 318–337 |
| 111 | 481–500 | 502–521 |
| 112 | 481–500 | 502–521 |
| 113 | 481–500 | 502–521 |
| 114 | 481–500 | 502–521 |
| 115 | 482–500* | 502–521 |
| 116 | 209–228 | 230–249 |
| 117 | 466–485 | 487–506 |
| 118 | 481–500 | 502–521 |
| 119 | 481–500 | 502–521 |
| 120 | 481–500 | 502–521 |
| 121 | 481–500 | 502–521 |
| 122 | 481–500 | 502–521 |
| 123 | 481–500 | 502–521 |

TABLE 12-continued

Microsequencing primers

| SEQ ID NO. | POSITION RANGE OF MICROSEQUENCING PRIMERS | COMPLEMENTARY POSITION RANGE OF MICROSEQUENCING PRIMERS |
|---|---|---|
| 124 | 481–500 | 502–521 |
| 125 | 481–500 | 502–521 |
| 126 | 477–496 | 498–517 |
| 127 | 481–500 | 502–521 |
| 128 | 481–500 | 502–521 |
| 129 | 481–500 | 502–521 |
| 130 | 481–500 | 502–521 |
| 131 | 481–500 | 502–521 |
| 132 | 481–500 | 502–521 |
| 133 | 481–500 | 502–521 |
| 134 | 481–500 | 502–521 |
| 135 | 481–500 | 502–521 |
| 136 | 481–500 | 502–521 |
| 137 | 481–500 | 502–521 |
| 138 | 481–500 | 502–521 |
| 139 | 481–500 | 502–521 |
| 140 | 481–500 | 502–521 |
| 141 | 481–500 | 502–521 |
| 142 | 481–500 | 502–520* |
| 143 | 481–500 | 502–521 |
| 144 | 481–500 | 502–521 |
| 145 | 481–500 | 502–521 |
| 146 | 481–500 | 502–521 |
| 147 | 482–500* | 502–521 |
| 148 | 481–500 | 502–521 |
| 149 | 481–500 | 502–520* |
| 150 | 482–500* | 502–521 |
| 151 | 481–500 | 502–521 |
| 152 | 481–500 | 502–521 |
| 153 | 481–500 | 502–521 |
| 154 | 481–500 | 502–521 |
| 155 | 481–500 | 502–521 |
| 156 | 481–500 | 502–521 |
| 157 | 481–500 | 502–521 |
| 158 | 481–500 | 502–521 |
| 159 | 481–500 | 502–521 |
| 160 | 481–500 | 502–521 |
| 161 | 481–500 | 502–521 |
| 162 | 481–500 | 502–521 |
| 163 | 481–500 | 502–521 |
| 164 | 488–507 | 509–528 |
| 165 | 481–500 | 502–521 |
| 166 | 481–500 | 502–521 |
| 167 | 481–500 | 502–521 |
| 168 | 481–500 | 502–521 |
| 169 | 481–500 | 502–521 |
| 170 | 481–500 | 502–521 |
| 171 | 481–500 | 502–521 |
| 172 | 481–500 | 502–521 |
| 173 | 481–500 | 502–521 |
| 174 | 481–500 | 502–521 |
| 175 | 481–500 | 502–521 |
| 176 | 481–500 | 502–521 |
| 177 | 481–500 | 502–521 |
| 178 | 481–500 | 502–521 |
| 179 | 521–540 | 542–561 |
| 180 | 481–500 | 502–521 |
| 181 | 481–500 | 502–521 |
| 182 | 481–500 | 502–521 |
| 183 | 481–500 | 502–521 |
| 184 | 481–500 | 502–521 |
| 185 | 481–500 | 502–521 |
| 186 | 481–500 | 502–521 |
| 187 | 481–500 | 502–521 |
| 188 | 481–500 | 502–521 |
| 189 | 481–500 | 502–521 |
| 190 | 481–500 | 502–521 |
| 191 | 481–500 | 502–521 |
| 192 | 481–500 | 502–521 |
| 193 | 481–500 | 502–520* |
| 194 | 481–500 | 502–521 |
| 195 | 481–500 | 502–520* |
| 196 | 482–500* | 502–521 |
| 197 | 481–500 | 502–521 |
| 198 | 481–500 | 502–520* |
| 199 | 481–500 | 502–521 |
| 200 | 481–500 | 502–521 |
| 201 | 482–500* | 502–521 |
| 202 | 481–500 | 502–521 |
| 203 | 481–500 | 502–520* |
| 204 | 481–500 | 502–521 |
| 205 | 481–500 | 502–521 |
| 206 | 481–500 | 502–521 |
| 207 | 481–500 | 502–521 |
| 208 | 481–500 | 502–521 |
| 209 | 481–500 | 502–521 |
| 210 | 481–500 | 502–521 |
| 211 | 481–500 | 502–521 |
| 212 | 481–500 | 502–521 |
| 213 | 481–500 | 502–521 |
| 214 | 481–500 | 502–521 |
| 215 | 481–500 | 502–521 |
| 216 | 481–500 | 502–521 |
| 217 | 481–500 | 502–521 |
| 218 | 481–500 | 502–521 |
| 219 | 481–500 | 502–521 |
| 220 | 481–500 | 502–521 |
| 221 | 481–500 | 502–521 |
| 222 | 52–71 | 73–92 |
| 223 | 53–72 | 74–93 |
| 224 | 59–78 | 80–99 |
| 225 | 118–137 | 139–158 |
| 226 | 62–80* | 82–101 |
| 227 | 21–40 | 42–61 |
| 228 | 15–34 | 36–54* |
| 229 | 254–273 | 275–294 |
| 230 | 113–132 | 134–153 |
| 231 | 178–196* | 198–217 |
| 232 | 178–197 | 199–218 |
| 233 | 342–361 | 363–382 |
| 234 | 368–386* | 388–407 |
| 235 | 390–408* | 410–429 |
| 236 | 287–306 | 308–326* |
| 237 | 227–246 | 248–267 |
| 238 | 274–293 | 295–313* |
| 239 | 328–346* | 348–367 |
| 240 | 84–103 | 105–124 |
| 241 | 304–322* | 324–343 |
| 242 | 383–402 | 404–423 |
| 243 | 78–97 | 99–118 |
| 244 | 269–287* | 289–308 |
| 245 | 361–379* | 381–400 |
| 246 | 141–159* | 161–180 |
| 247 | 187–205* | 207–226 |
| 248 | 263–282 | 284–303 |
| 249 | 297–316 | 318–337 |
| 250 | 481–500 | 502–520* |
| 251 | 481–500 | 502–521 |
| 252 | 482–500* | 502–521 |
| 253 | 481–500 | 502–521 |
| 254 | 481–500 | 502–521 |
| 255 | 501–520 | 522–541 |
| 256 | 482–500* | 502–521 |
| 257 | 481–500 | 502–521 |
| 258 | 482–500* | 502–521 |
| 259 | 482–500* | 502–521 |
| 260 | 481–500 | 502–521 |
| 261 | 481–500 | 502–521 |
| 262 | 481–500 | 502–521 |
| 263 | 480–499 | 501–520 |
| 264 | 481–500 | 502–521 |
| 265 | 481–500 | 502–521 |
| 266 | 481–500 | 502–521 |
| 267 | 481–500 | 502–521 |
| 268 | 481–500 | 502–521 |
| 269 | 481–500 | 502–521 |

TABLE 12-continued

Microsequencing primers

| SEQ ID NO. | POSITION RANGE OF MICROSEQUENCING PRIMERS | COMPLEMENTARY POSITION RANGE OF MICROSEQUENCING PRIMERS |
|---|---|---|
| 270 | 481–500 | 502–521 |
| 271 | 481–500 | 502–521 |
| 272 | 481–500 | 502–521 |
| 273 | 481–500 | 502–521 |
| 274 | 481–500 | 502–521 |
| 275 | 482–501 | 503–522 |
| 276 | 481–500 | 502–521 |
| 277 | 463–482 | 484–503 |
| 278 | 481–500 | 502–521 |
| 279 | 481–500 | 502–521 |
| 280 | 480–499 | 501–520 |
| 281 | 456–475 | 477–496 |
| 282 | 478–497 | 499–518 |
| 283 | 481–500 | 502–521 |
| 284 | 481–500 | 502–521 |
| 285 | 481–500 | 502–521 |
| 286 | 481–500 | 502–521 |
| 287 | 481–500 | 502–521 |
| 288 | 425–444 | 446–465 |
| 289 | 481–500 | 502–521 |
| 290 | 479–498 | 500–519 |
| 291 | 481–500 | 502–521 |
| 292 | 481–500 | 502–521 |
| 293 | 481–500 | 502–521 |
| 294 | 481–500 | 502–521 |
| 295 | 481–500 | 502–521 |
| 296 | 481–500 | 502–521 |
| 297 | 481–500 | 502–521 |
| 298 | 481–500 | 502–521 |
| 299 | 359–378 | 380–399 |
| 300 | 366–385 | 387–406 |
| 301 | 481–500 | 502–521 |
| 302 | 482–500* | 502–521 |
| 303 | 481–500 | 502–521 |
| 304 | 481–500 | 502–520* |
| 305 | 419–438 | 440–459 |
| 306 | 258–277 | 279–297* |
| 307 | 306–325 | 327–346 |
| 308 | 318–337 | 339–358 |
| 309 | 393–412 | 414–433 |
| 310 | 482–500* | 502–521 |
| 311 | 481–500 | 502–520* |
| 312 | 482–500* | 502–521 |
| 313 | 481–500 | 502–521 |
| 314 | 482–500* | 502–521 |
| 315 | 481–500 | 502–520* |
| 316 | 481–500 | 502–520* |
| 317 | 482–500* | 502–521 |
| 318 | 482–500* | 502–521 |
| 319 | 482–500* | 502–521 |
| 320 | 481–500 | 502–521 |
| 321 | 481–500 | 502–521 |
| 322 | 481–500 | 502–521 |
| 323 | 481–500 | 502–521 |
| 324 | 366–385 | 387–406 |
| 325 | 221–239* | 241–260 |
| 326 | 256–275 | 277–295* |
| 327 | 22–41 | 43–62 |
| 328 | 322–340* | 342–361 |
| 329 | 245–263* | 265–284 |
| 330 | 259–277* | 279–298 |
| 331 | 157–175* | 177–196 |
| 332 | 94–113 | 115–134 |
| 333 | 156–175 | 177–195* |
| 334 | 222–241 | 243–261* |
| 335 | 330–349 | 351–369* |
| 336 | 23–41* | 43–62 |
| 337 | 355–373* | 375–394 |
| 338 | 239–258 | 260–279 |
| 339 | 481–500 | 502–521 |
| 340 | 482–500* | 502–521 |
| 341 | 481–500 | 502–521 |
| 342 | 481–500 | 502–521 |
| 343 | 481–500 | 502–521 |
| 344 | 481–500 | 502–521 |
| 345 | 481–500 | 502–521 |
| 346 | 481–500 | 502–521 |
| 347 | 481–500 | 502–521 |
| 348 | 481–500 | 502–521 |
| 349 | 481–500 | 502–521 |
| 350 | 456–475 | 477–496 |
| 351 | 482–500* | 502–521 |
| 352 | 481–500 | 502–521 |
| 353 | 481–500 | 502–521 |
| 354 | 481–500 | 502–521 |
| 355 | 481–500 | 502–521 |
| 356 | 481–500 | 502–521 |
| 357 | 481–500 | 502–521 |
| 358 | 482–500* | 502–521 |
| 359 | 481–500 | 502–521 |
| 360 | 481–500 | 502–521 |
| 361 | 481–500 | 502–521 |
| 362 | 481–500 | 502–521 |
| 363 | 481–500 | 502–521 |
| 364 | 481–500 | 502–521 |
| 365 | 481–500 | 502–521 |
| 366 | 481–500 | 502–521 |
| 367 | 481–500 | 502–521 |
| 368 | 481–500 | 502–521 |
| 369 | 482–500* | 502–521 |
| 370 | 481–500 | 502–521 |
| 371 | 481–500 | 502–521 |
| 372 | 481–500 | 502–521 |
| 373 | 481–500 | 502–521 |
| 374 | 481–500 | 502–521 |
| 375 | 481–500 | 502–521 |
| 376 | 481–500 | 502–521 |
| 377 | 481–500 | 502–521 |
| 378 | 481–500 | 502–521 |
| 379 | 481–500 | 502–521 |
| 380 | 481–500 | 502–521 |
| 381 | 481–500 | 502–521 |
| 382 | 481–500 | 502–521 |
| 383 | 481–500 | 502–521 |
| 384 | 481–500 | 502–521 |
| 385 | 481–500 | 502–521 |
| 386 | 481–500 | 502–521 |
| 387 | 482–500* | 502–521 |
| 388 | 481–500 | 502–521 |
| 389 | 481–500 | 502–521 |
| 390 | 481–500 | 502–521 |
| 391 | 481–500 | 502–521 |
| 392 | 482–500* | 502–521 |
| 393 | 481–500 | 502–521 |
| 394 | 459–478 | 480–499 |
| 395 | 481–500 | 502–521 |
| 396 | 481–500 | 502–520* |
| 397 | 481–500 | 502–521 |
| 398 | 481–500 | 502–521 |
| 399 | 481–500 | 502–521 |
| 400 | 508–527 | 529–548 |
| 401 | 481–500 | 502–520* |
| 402 | 482–500* | 502–521 |
| 403 | 481–500 | 502–521 |
| 404 | 481–500 | 502–520* |
| 405 | 482–500* | 502–521 |
| 406 | 481–500 | 502–520* |
| 407 | 481–500 | 502–520* |
| 408 | 481–500 | 502–520* |
| 409 | 481–500 | 502–521 |
| 410 | 26–44* | 46–65 |
| 411 | 43–62 | 64–83 |
| 412 | 157–176 | 178–197 |
| 413 | 382–401 | 403–422 |
| 414 | 117–135* | 137–156 |
| 415 | 121–139* | 141–160 |

TABLE 12-continued

Microsequencing primers

| SEQ ID NO. | POSITION RANGE OF MICROSEQUENCING PRIMERS | COMPLEMENTARY POSITION RANGE OF MICROSEQUENCING PRIMERS |
|---|---|---|
| 416 | 19–38 | 40–59 |
| 417 | 46–64* | 66–85 |
| 418 | 237–256 | 258–276* |
| 425 | 350–368* | 370–389 |
| 426 | 15–34 | 36–55 |
| 427 | 82–101 | 103–122 |
| 428 | 105–123* | 125–144 |
| 429 | 164–182* | 184–203 |
| 430 | 362–381 | 383–402 |
| 431 | 14–32* | 34–53 |
| 432 | 130–149 | 151–169* |
| 433 | 202–221 | 223–241* |
| 434 | 230–249 | 251–270 |
| 435 | 334–353 | 355–373* |
| 436 | 22–41 | 43–62 |
| 437 | 137–155* | 157–176 |
| 438 | 206–225 | 227–246 |
| 439 | 481–500 | 502–521 |
| 440 | 481–500 | 502–521 |
| 441 | 482–500* | 502–521 |
| 442 | 481–500 | 502–521 |
| 443 | 481–500 | 502–521 |
| 444 | 481–500 | 502–521 |
| 445 | 481–500 | 502–521 |
| 446 | 482–500* | 502–521 |
| 447 | 482–500* | 502–521 |
| 448 | 481–500 | 502–521 |
| 449 | 481–500 | 502–521 |
| 450 | 481–500 | 502–521 |
| 451 | 481–500 | 502–521 |
| 452 | 481–500 | 502–521 |
| 453 | 481–500 | 502–521 |
| 454 | 481–500 | 502–521 |
| 455 | 481–500 | 502–521 |
| 456 | 481–500 | 502–521 |
| 457 | 481–500 | 502–521 |
| 458 | 481–500 | 502–521 |
| 459 | 482–500* | 502–521 |
| 460 | 481–500 | 502–520* |
| 461 | 481–500 | 502–521 |
| 462 | 481–500 | 502–521 |
| 463 | 482–500* | 502–521 |
| 464 | 481–500 | 502–521 |
| 465 | 482–500* | 502–521 |
| 466 | 481–500 | 502–521 |
| 467 | 481–500 | 502–521 |
| 468 | 481–500 | 502–521 |
| 469 | 481–500 | 502–521 |
| 470 | 481–500 | 502–520* |
| 471 | 482–500* | 502–521 |
| 472 | 481–500 | 502–521 |
| 473 | 481–500 | 502–521 |
| 474 | 481–500 | 502–521 |
| 475 | 481–500 | 502–521 |
| 476 | 481–500 | 502–521 |
| 477 | 482–500* | 502–521 |
| 478 | 481–500 | 502–521 |
| 479 | 481–500 | 502–521 |
| 480 | 483–500* | 502–521 |
| 481 | 481–500 | 502–521 |
| 482 | 481–500 | 502–521 |
| 483 | 481–500 | 502–521 |
| 484 | 481–500 | 502–520* |
| 485 | 482–500* | 502–520* |
| 486 | 481–500 | 502–521 |
| 487 | 119–138 | 140–158* |
| 488 | 192–211 | 213–231* |
| 489 | 222–240* | 242–261 |
| 491 | 166–184* | 186–205 |
| 492 | 245–263* | 265–284 |
| 493 | 2–21 | 23–42 |
| 494 | 133–151* | 153–172 |
| 495 | 237–255* | 257–276 |
| 496 | 263–281* | 283–302 |
| 497 | 261–280 | 282–301 |
| 498 | 123–141* | 143–162 |
| 499 | 282–301 | 303–322 |
| 500 | 311–330 | 332–351 |
| 501 | 133–151* | 153–172 |
| 502 | 238–257 | 259–278 |
| 503 | 84–102* | 104–123 |
| 504 | 125–143* | 145–164 |
| 505 | 255–274 | 276–294* |
| 506 | 208–226* | 228–247 |
| 507 | 136–154* | 156–175 |
| 508 | 361–380 | 382–401 |
| 509 | 78–97 | 99–118 |
| 510 | 481–500 | 502–520* |
| 511 | 482–500* | 502–521 |
| 512 | 481–500 | 502–520* |
| 513 | 481–500 | 502–521 |
| 514 | 481–500 | 502–521 |
| 515 | 481–500 | 502–521 |
| 516 | 481–500 | 502–521 |
| 517 | 482–500* | 502–521 |
| 518 | 482–500* | 502–521 |
| 519 | 481–500 | 502–521 |
| 520 | 481–500 | 502–521 |
| 521 | 481–500 | 502–521 |
| 522 | 481–500 | 502–521 |
| 523 | 481–500 | 502–521 |
| 524 | 481–500 | 502–521 |
| 525 | 481–500 | 502–521 |
| 526 | 481–500 | 502–521 |
| 527 | 481–500 | 502–521 |
| 528 | 307–326 | 328–346* |
| 529 | 32–51 | 53–72 |
| 530 | 27–45* | 47–66 |
| 532 | 91–109* | 111–130 |
| 533 | 253–272 | 274–292* |
| 534 | 71–89* | 91–110 |
| 535 | 184–203 | 205–223* |
| 536 | 201–220 | 222–241 |
| 537 | 214–233 | 235–253* |
| 538 | 268–287 | 289–308 |
| 539 | 291–310 | 312–331 |
| 541 | 20–38* | 40–59 |
| 542 | 100–119 | 121–140 |
| 543 | 134–153 | 155–174 |
| 544 | 81–100 | 102–119* |
| 545 | 67–85* | 87–106 |
| 546 | 72–91 | 93–112 |
| 547 | 74–93 | 95–114 |
| 548 | 481–500 | 502–521 |
| 549 | 396–415 | 417–436 |
| 550 | 68–87 | 89–108 |
| 551 | 268–286* | 288–307 |
| 552 | 419–438 | 440–459 |
| 553 | 482–500* | 502–521 |
| 554 | 482–500* | 502–521 |
| 555 | 481–500 | 502–520* |
| 556 | 481–500 | 502–521 |
| 557 | 482–500* | 502–521 |
| 558 | 481–500 | 502–521 |
| 559 | 481–500 | 502–520* |
| 560 | 481–500 | 502–520* |
| 561 | 481–500 | 502–521 |
| 562 | 481–500 | 502–520* |
| 563 | 481–500 | 502–521 |
| 564 | 481–500 | 502–520* |
| 565 | 230–249 | 251–270 |
| 566 | 66–84* | 86–105 |
| 567 | 31–50 | 52–71 |
| 568 | 187–206 | 208–227 |
| 569 | 378–396* | 398–416* |
| 570 | 200–218* | 220–239 |

TABLE 12-continued

Microsequencing primers

| SEQ ID NO. | POSITION RANGE OF MICROSEQUENCING PRIMERS | COMPLEMENTARY POSITION RANGE OF MICROSEQUENCING PRIMERS |
|---|---|---|
| 571 | 65–84 | — |
| 572 | 251–270 | — |
| 573 | 143–162 | — |
| 574 | 62–81 | — |
| 575 | 195–213* | — |
| 576 | 471–490 | — |
| 577 | 478–497 | — |
| 578 | 477–496 | — |
| 579 | 478–497 | — |
| 580 | — | 459–477* |
| 581 | — | 498–516* |
| 582 | 478–497 | — |
| 583 | 477–496 | — |
| 584 | 389–408 | — |
| 585 | 235–254 | — |
| 586 | 479–497* | — |
| 587 | 478–497 | — |
| 588 | 95–113* | — |
| 589 | 478–497 | — |
| 590 | 478–497 | — |
| 591 | 478–497 | — |
| 592 | 478–497 | — |
| 593 | 479–498 | — |
| 594 | 478–497 | — |
| 595 | 438–457 | — |
| 596 | 481–500 | 502–521 |
| 597 | 481–500 | 502–521 |
| 598 | 481–500 | 502–521 |
| 599 | 481–500 | 502–521 |
| 600 | 481–500 | — |
| 601 | 481–500 | 502–521 |
| 602 | 481–500 | 502–521 |
| 603 | 481–500 | 502–521 |
| 604 | 481–500 | 502–521 |
| 605 | 481–500 | 502–521 |
| 606 | — | 503–522 |
| 607 | 121–140 | 142–161 |
| 608 | 138–157 | 159–178 |
| 609 | 247–266 | 268–287 |
| 610 | 317–336 | 338–357 |
| 611 | 346–365 | 367–386 |
| 612 | 397–416 | 418–437 |
| 613 | 374–395 | — |
| 614 | 481–500 | 502–521 |
| 615 | 481–500 | — |
| 616 | 481–500 | 502–521 |
| 617 | 481–500 | 502–521 |
| 618 | 481–500 | 502–521 |
| 619 | 481–500 | 502–521 |
| 620 | 481–500 | — |
| 621 | 481–500 | 502–521 |
| 622 | 481–500 | — |
| 623 | 481–500 | 502–521 |
| 624 | 481–500 | 502–520* |
| 625 | 480–499 | 501–520 |
| 626 | 481–500 | 502–521 |
| 627 | 481–500 | 502–521 |
| 628 | 481–500 | — |
| 629 | 481–500 | 502–521 |
| 630 | 481–500 | 502–521 |
| 631 | 481–500 | 502–521 |
| 632 | 481–500 | 502–521 |
| 633 | 481–500 | 502–521 |
| 634 | 481–500 | 502–521 |
| 635 | 481–500 | 502–521 |
| 636 | 481–500 | 502–521 |
| 637 | 481–500 | 502–521 |
| 638 | 481–500 | — |
| 639 | 481–500 | — |
| 640 | 481–500 | 502–521 |
| 641 | 481–500 | 502–521 |
| 642 | 481–500 | 502–521 |
| 643 | 481–500 | 502–521 |
| 644 | 481–500 | 502–521 |
| 645 | 481–500 | 502–521 |
| 646 | 481–500 | 502–521 |
| 647 | 481–500 | 502–521 |
| 648 | 481–500 | 502–521 |
| 649 | 481–500 | 502–521 |
| 650 | 481–500 | 502–521 |

TABLE 13

Amplification primers

| SEQ ID NO. | POSITION RANGE OF AMPLIFICATION PRIMERS | COMPLEMENTARY POSITION RANGE OF AMPLIFICATION PRIMERS |
|---|---|---|
| 1 | 361–379 | 761–780 |
| 2 | 181–199 | 581–600 |
| 3 | 164–182 | 564–583 |
| 4 | 324–343 | 536–553 |
| 5 | 294–310 | 743–760 |
| 6 | 221–237 | 670–687 |
| 7 | 70–86 | 519–536 |
| 8 | 326–343 | 760–780 |
| 9 | 307–324 | 557–575 |
| 10 | 237–254 | 487–505 |
| 11 | 153–170 | 590–607 |
| 12 | 121–139 | 522–541 |
| 13 | 304–322 | 705–723 |
| 14 | 268–286 | 669–687 |
| 15 | 245–263 | 646–664 |
| 16 | 209–227 | 610–628 |
| 17 | 152–170 | 553–571 |
| 18 | 189–206 | 525–542 |
| 19 | 120–137 | 526–543 |
| 20 | 88–105 | 494–511 |
| 21 | 315–334 | 741–760 |
| 22 | 287–306 | 621–638 |
| 23 | 266–286 | 764–782 |
| 24 | 271–291 | 769–787 |
| 25 | 238–257 | 617–637 |
| 26 | 222–239 | 635–654 |
| 27 | 140–157 | 553–572 |
| 28 | 405–422 | 826–845 |
| 29 | 368–385 | 789–808 |
| 30 | 314–331 | 735–754 |
| 31 | 276–293 | 697–716 |
| 32 | 259–276 | 680–699 |
| 33 | 209–226 | 630–649 |
| 34 | 132–149 | 553–572 |
| 35 | 90–109 | 488–507 |
| 36 | 432–451 | 829–848 |
| 37 | 382–401 | 779–798 |
| 38 | 337–356 | 734–753 |
| 39 | 255–274 | 652–671 |
| 40 | 114–133 | 511–530 |
| 41 | 447–464 | 845–864 |
| 42 | 363–380 | 771–789 |
| 43 | 160–177 | 568–586 |
| 44 | 1–20 | 450–469 |
| 45 | 1–19 | 380–399 |
| 46 | 1–20 | 380–400 |
| 47 | 398–415 | 835–854 |
| 48 | 1–21 | 487–507 |
| 49 | 1–20 | 429–448 |
| 50 | 1–20 | 429–448 |
| 51 | 1–20 | 429–448 |
| 52 | 1–20 | 479–499 |
| 53 | 1–20 | 467–486 |
| 54 | 1–20 | 465–485 |

TABLE 13-continued

Amplification primers

| SEQ ID NO. | POSITION RANGE OF AMPLIFICATION PRIMERS | COMPLEMENTARY POSITION RANGE OF AMPLIFICATION PRIMERS |
|---|---|---|
| 55 | 1–20 | 465–485 |
| 56 | 76–96 | 505–525 |
| 57 | 1–21 | 387–407 |
| 58 | 1–20 | 449–468 |
| 59 | 1–20 | 449–468 |
| 60 | 1–19 | 581–598 |
| 61 | 1–19 | 490–508 |
| 62 | 1–19 | 490–508 |
| 63 | 1–21 | 437–456 |
| 64 | 1–21 | 437–456 |
| 65 | 1–20 | 401–420 |
| 66 | 1–19 | 470–490 |
| 67 | 1–19 | 470–490 |
| 68 | 1–19 | 470–490 |
| 69 | 478–495 | 879–898 |
| 70 | 119–137 | 540–557 |
| 72 | 138–157 | 538–556 |
| 73 | 472–490 | 900–917 |
| 74 | 431–449 | 859–876 |
| 75 | 374–392 | 802–819 |
| 76 | 243–261 | 671–688 |
| 77 | 113–131 | 541–558 |
| 78 | 161–179 | 561–580 |
| 79 | 220–238 | 620–638 |
| 80 | 261–279 | 595–614 |
| 81 | 317–335 | 720–738 |
| 82 | 374–393 | 732–751 |
| 83 | 293–312 | 701–720 |
| 84 | 470–488 | 901–921 |
| 85 | 185–203 | 590–609 |
| 86 | 90–107 | 509–528 |
| 87 | 83–103 | 652–671 |
| 88 | 140–160 | 709–728 |
| 89 | 361–381 | 930–949 |
| 90 | 437–456 | 885–905 |
| 91 | 298–318 | 727–747 |
| 92 | 385–404 | 832–852 |
| 93 | 332–351 | 779–799 |
| 94 | 234–253 | 681–701 |
| 95 | 347–367 | 816–836 |
| 96 | 463–483 | 932–952 |
| 97 | 136–155 | 591–611 |
| 98 | 75–94 | 530–550 |
| 99 | 290–310 | 669–688 |
| 100 | 290–310 | 669–688 |
| 101 | 325–343 | 756–776 |
| 102 | 71–90 | 503–519 |
| 103 | 136–154 | 571–590 |
| 104 | 417–435 | 930–949 |
| 105 | 5–23 | 530–549 |
| 106 | 285–304 | 749–769 |
| 107 | 222–241 | 686–706 |
| 108 | 4–22 | 446–466 |
| 109 | 198–218 | 634–654 |
| 110 | 53–70 | 504–523 |
| 111 | 450–468 | 881–899 |
| 112 | 93–111 | 524–542 |
| 113 | 285–303 | 746–766 |
| 114 | 103–121 | 564–584 |
| 115 | 147–165 | 587–607 |
| 116 | 9–29 | 435–455 |
| 117 | 187–206 | 636–656 |
| 118 | 406–425 | 797–816 |
| 119 | 384–403 | 775–794 |
| 120 | 354–373 | 745–764 |
| 121 | 216–235 | 607–626 |
| 122 | 402–420 | 735–752 |
| 123 | 301–319 | 707–724 |
| 124 | 324–341 | 618–635 |
| 125 | 134–153 | 533–552 |
| 126 | 478–495 | 906–924 |
| 127 | 399–416 | 827–845 |
| 128 | 178–195 | 606–624 |
| 129 | 475–493 | 879–896 |
| 130 | 179–197 | 583–600 |
| 131 | 265–284 | 694–714 |
| 132 | 277–295 | 720–740 |
| 133 | 360–378 | 867–887 |
| 134 | 309–327 | 816–836 |
| 135 | 442–462 | 898–918 |
| 136 | 383–403 | 839–859 |
| 137 | 365–385 | 821–841 |
| 138 | 356–376 | 812–832 |
| 139 | 104–124 | 560–580 |
| 140 | 389–408 | 879–898 |
| 141 | 338–357 | 828–847 |
| 142 | 337–356 | 827–846 |
| 143 | 57–76 | 547–566 |
| 144 | 301–320 | 682–701 |
| 145 | 10–30 | 524–542 |
| 146 | 386–406 | 844–862 |
| 147 | 47–67 | 547–566 |
| 148 | 268–288 | 768–787 |
| 149 | 478–498 | 903–922 |
| 150 | 391–410 | 828–846 |
| 151 | 385–404 | 822–840 |
| 152 | 316–336 | 745–765 |
| 153 | 378–398 | 807–827 |
| 154 | 427–447 | 856–876 |
| 155 | 67–86 | 512–530 |
| 156 | 112–131 | 557–575 |
| 157 | 380–399 | 825–843 |
| 158 | 387–406 | 832–850 |
| 159 | 183–201 | 672–692 |
| 160 | 321–340 | 767–787 |
| 161 | 200–219 | 646–666 |
| 162 | 262–281 | 761–780 |
| 163 | 247–266 | 746–765 |
| 164 | 1–21 | 527–544 |
| 165 | 42–62 | 568–585 |
| 166 | 153–173 | 679–696 |
| 167 | 441–461 | 967–984 |
| 168 | 364–382 | 900–920 |
| 169 | 127–145 | 663–683 |
| 170 | 330–349 | 769–788 |
| 171 | 284–303 | 723–742 |
| 172 | 176–195 | 615–634 |
| 173 | 110–129 | 549–568 |
| 174 | 222–242 | 688–708 |
| 175 | 118–135 | 628–647 |
| 176 | 245–264 | 749–768 |
| 177 | 128–147 | 632–651 |
| 178 | 79–98 | 583–602 |
| 179 | 1–21 | 545–563 |
| 180 | 116–136 | 660–678 |
| 181 | 355–373 | 811–828 |
| 182 | 403–421 | 859–876 |
| 183 | 74–94 | 649–668 |
| 184 | 408–428 | 983–1002 |
| 185 | 224–242 | 627–646 |
| 186 | 366–385 | 765–784 |
| 187 | 221–239 | 646–665 |
| 188 | 111–129 | 512–531 |
| 189 | 246–263 | 661–679 |
| 190 | 114–133 | 610–627 |
| 191 | 9–28 | 505–522 |
| 192 | 107–126 | 537–557 |
| 193 | 405–424 | 891–911 |
| 194 | 216–234 | 653–673 |
| 195 | 180–198 | 617–637 |
| 196 | 129–149 | 661–678 |
| 197 | 220–240 | 752–769 |
| 198 | 352–372 | 849–867 |
| 199 | 349–369 | 856–875 |
| 200 | 461–481 | 968–987 |
| 201 | 369–389 | 798–817 |

TABLE 13-continued

Amplification primers

| SEQ ID NO. | POSITION RANGE OF AMPLIFICATION PRIMERS | COMPLEMENTARY POSITION RANGE OF AMPLIFICATION PRIMERS |
|---|---|---|
| 202 | 110–130 | 539–558 |
| 203 | 329–346 | 723–741 |
| 204 | 62–79 | 567–587 |
| 205 | 130–150 | 558–578 |
| 206 | 131–151 | 559–579 |
| 207 | 267–284 | 795–815 |
| 208 | 304–324 | 770–787 |
| 209 | 216–234 | 712–731 |
| 210 | 188–207 | 659–674 |
| 211 | 172–192 | 645–663 |
| 212 | 194–214 | 674–693 |
| 213 | 63–83 | 543–562 |
| 214 | 236–256 | 687–705 |
| 215 | 268–288 | 719–737 |
| 216 | 335–355 | 786–804 |
| 217 | 463–482 | 899–918 |
| 218 | 72–91 | 508–527 |
| 219 | 115–135 | 555–573 |
| 220 | 236–256 | 681–700 |
| 221 | 290–310 | 735–754 |
| 222 | 1–18 | 345–362 |
| 223 | 1–18 | 345–362 |
| 224 | 1–18 | 345–362 |
| 225 | 1–18 | 345–362 |
| 226 | 1–18 | 349–368 |
| 227 | 1–19 | 401–420 |
| 228 | 1–18 | 409–427 |
| 229 | 1–18 | 402–420 |
| 230 | 1–19 | 407–426 |
| 231 | 1–19 | 403–420 |
| 232 | 1–19 | 403–420 |
| 233 | 1–18 | 363–380 |
| 234 | 1–12 | 444–464 |
| 235 | 1–12 | 444–464 |
| 236 | 1–18 | 343–361 |
| 237 | 1–19 | 418–435 |
| 238 | 1–19 | 418–435 |
| 239 | 1–19 | 418–435 |
| 240 | 1–19 | 420–439 |
| 241 | 1–19 | 420–439 |
| 242 | 1–19 | 420–439 |
| 243 | 1–19 | 406–424 |
| 244 | 1–19 | 406–424 |
| 245 | 1–19 | 406–424 |
| 246 | 1–18 | 354–371 |
| 247 | 1–18 | 354–371 |
| 248 | 1–18 | 354–371 |
| 249 | 1–20 | 408–425 |
| 250 | 130–149 | 562–579 |
| 251 | 444–464 | 875–894 |
| 252 | 133–151 | 564–584 |
| 253 | 411–429 | 842–862 |
| 254 | 292–312 | 819–839 |
| 255 | 6–26 | 533–553 |
| 256 | 101–121 | 547–564 |
| 257 | 419–437 | 866–886 |
| 258 | 347–366 | 776–796 |
| 259 | 253–273 | 749–768 |
| 260 | 127–146 | 656–675 |
| 261 | 408–428 | 849–859 |
| 262 | 119–139 | 560–570 |
| 263 | 118–138 | 559–569 |
| 264 | 111–131 | 552–562 |
| 265 | 288–307 | 791–810 |
| 266 | 147–166 | 650–669 |
| 267 | 65–84 | 527–546 |
| 268 | 17–37 | 542–562 |
| 269 | 438–458 | 963–983 |
| 270 | 329–347 | 774–794 |
| 271 | 337–357 | 792–811 |
| 272 | 92–112 | 540–559 |
| 273 | 315–335 | 746–764 |
| 274 | 330–350 | 761–779 |
| 275 | 331–351 | 762–780 |
| 276 | 424–444 | 855–873 |
| 277 | 306–326 | 737–757 |
| 278 | 449–468 | 879–898 |
| 279 | 368–386 | 909–929 |
| 280 | 266–284 | 807–827 |
| 281 | 242–260 | 783–803 |
| 282 | 242–260 | 783–803 |
| 283 | 227–245 | 768–788 |
| 284 | 323–342 | 895–915 |
| 285 | 448–468 | 877–897 |
| 286 | 98–118 | 527–547 |
| 287 | 128–148 | 557–577 |
| 288 | 1–21 | 483–502 |
| 289 | 248–268 | 697–715 |
| 290 | 478–498 | 927–945 |
| 291 | 245–265 | 649–667 |
| 292 | 415–435 | 843–863 |
| 293 | 294–312 | 786–796 |
| 294 | 379–397 | 835–855 |
| 295 | 293–312 | 723–742 |
| 296 | 444–462 | 845–863 |
| 297 | 365–383 | 766–784 |
| 298 | 270–288 | 671–689 |
| 299 | 276–296 | 733–753 |
| 300 | 276–296 | 733–753 |
| 301 | 227–247 | 684–704 |
| 302 | 301–318 | 733–751 |
| 303 | 289–306 | 721–739 |
| 304 | 373–393 | 831–851 |
| 305 | 5–23 | 442–462 |
| 306 | 130–148 | 577–597 |
| 307 | 130–148 | 577–597 |
| 308 | 130–148 | 577–597 |
| 309 | 130–148 | 577–597 |
| 310 | 288–307 | 756–775 |
| 311 | 445–463 | 901–921 |
| 312 | 41–61 | 509–526 |
| 313 | 195–213 | 636–656 |
| 314 | 307–327 | 816–834 |
| 315 | 362–381 | 794–814 |
| 316 | 182–200 | 677–696 |
| 317 | 114–132 | 609–628 |
| 318 | 252–270 | 697–717 |
| 319 | 262–280 | 741–761 |
| 320 | 386–403 | 754–771 |
| 321 | 228–245 | 632–651 |
| 322 | 426–443 | 827–846 |
| 323 | 238–255 | 660–678 |
| 324 | 1–18 | 412–429 |
| 325 | 1–20 | 419–438 |
| 326 | 1–19 | 408–425 |
| 327 | 2–20 | 403–422 |
| 328 | 2–20 | 403–422 |
| 329 | 1–17 | 405–418 |
| 330 | 1–19 | 410–429 |
| 331 | 1–19 | 401–420 |
| 332 | 1–20 | 409–428 |
| 333 | 1–18 | 290–307 |
| 334 | 3–20 | 410–429 |
| 335 | 1–18 | 368–385 |
| 336 | 1–18 | 424–443 |
| 337 | 1–18 | 424–443 |
| 338 | 1–18 | 430–447 |
| 339 | 340–358 | 739–758 |
| 340 | 299–317 | 817–837 |
| 341 | 236–253 | 638–657 |
| 342 | 152–169 | 554–573 |
| 343 | 108–125 | 510–529 |
| 344 | 357–374 | 779–798 |
| 345 | 438–457 | 942–962 |
| 346 | 30–49 | 534–554 |
| 347 | 234–254 | 674–694 |

TABLE 13-continued

Amplification primers

| SEQ ID NO. | POSITION RANGE OF AMPLIFICATION PRIMERS | COMPLEMENTARY POSITION RANGE OF AMPLIFICATION PRIMERS |
|---|---|---|
| 348 | 328–348 | 768–788 |
| 349 | 463–483 | 903–923 |
| 350 | 452–471 | 965–985 |
| 351 | 371–391 | 827–846 |
| 352 | 468–488 | 924–943 |
| 353 | 367–387 | 866–885 |
| 354 | 232–251 | 668–688 |
| 355 | 153–171 | 607–626 |
| 356 | 137–155 | 591–610 |
| 357 | 50–68 | 504–523 |
| 358 | 79–98 | 589–609 |
| 359 | 455–474 | 898–918 |
| 360 | 322–340 | 789–809 |
| 361 | 305–323 | 772–792 |
| 362 | 221–239 | 688–708 |
| 363 | 374–394 | 813–833 |
| 364 | 11–31 | 528–548 |
| 365 | 450–470 | 893–911 |
| 366 | 209–229 | 652–670 |
| 367 | 151–169 | 667–685 |
| 368 | 285–303 | 801–819 |
| 369 | 251–271 | 727–747 |
| 370 | 242–261 | 745–765 |
| 371 | 257–276 | 760–780 |
| 372 | 431–450 | 934–954 |
| 373 | 443–462 | 875–895 |
| 374 | 433–452 | 865–885 |
| 375 | 423–442 | 855–875 |
| 376 | 349–369 | 839–859 |
| 377 | 83–103 | 573–593 |
| 378 | 435–453 | 951–971 |
| 379 | 64–82 | 580–600 |
| 380 | 292–311 | 723–743 |
| 381 | 113–132 | 544–564 |
| 382 | 229–248 | 674–694 |
| 383 | 235–255 | 677–696 |
| 384 | 372–392 | 814–833 |
| 385 | 446–466 | 888–907 |
| 386 | 449–469 | 891–910 |
| 387 | 246–266 | 674–694 |
| 388 | 399–419 | 827–847 |
| 389 | 184–204 | 683–701 |
| 390 | 450–470 | 949–967 |
| 391 | 148–168 | 578–598 |
| 392 | 253–273 | 683–703 |
| 393 | 365–385 | 795–815 |
| 394 | 426–445 | 976–995 |
| 395 | 309–329 | 745–765 |
| 396 | 348–368 | 870–889 |
| 397 | 138–158 | 622–640 |
| 398 | 106–126 | 595–615 |
| 399 | 216–236 | 705–725 |
| 400 | 6–26 | 558–576 |
| 401 | 116–134 | 600–619 |
| 402 | 105–125 | 566–584 |
| 403 | 386–406 | 847–865 |
| 404 | 296–315 | 781–799 |
| 405 | 142–160 | 521–541 |
| 406 | 443–460 | 901–921 |
| 407 | 287–306 | 765–785 |
| 408 | 217–236 | 664–683 |
| 409 | 399–418 | 846–865 |
| 410 | 1–20 | 349–366 |
| 411 | 1–20 | 349–366 |
| 412 | 1–18 | 412–429 |
| 413 | 1–18 | 412–429 |
| 414 | 1–16 | 333–349 |
| 415 | 1–16 | 333–349 |
| 416 | 1–18 | 400–420 |
| 417 | 1–18 | 407–424 |
| 418 | 1–18 | 400–420 |
| 425 | 1–18 | 398–417 |
| 426 | 1–18 | 398–417 |
| 427 | 1–20 | 404–423 |
| 428 | 1–20 | 404–423 |
| 429 | 1–18 | 403–421 |
| 430 | 1–18 | 403–421 |
| 431 | 1–19 | 402–419 |
| 432 | 1–20 | 405–422 |
| 433 | 1–18 | 335–352 |
| 434 | 1–18 | 335–352 |
| 435 | 1–18 | 413–432 |
| 436 | 1–19 | 283–300 |
| 437 | 1–19 | 283–300 |
| 439 | 243–263 | 674–692 |
| 440 | 393–412 | 802–819 |
| 441 | 114–134 | 543–563 |
| 442 | 123–141 | 542–561 |
| 443 | 386–403 | 792–809 |
| 444 | 153–170 | 559–576 |
| 445 | 409–426 | 821–838 |
| 446 | 355–374 | 783–803 |
| 447 | 90–109 | 600–620 |
| 448 | 199–219 | 670–690 |
| 449 | 467–486 | 915–935 |
| 450 | 383–403 | 812–832 |
| 451 | 211–229 | 688–707 |
| 452 | 33–53 | 586–605 |
| 453 | 376–395 | 840–860 |
| 454 | 92–111 | 556–576 |
| 455 | 124–142 | 553–573 |
| 456 | 286–306 | 745–764 |
| 457 | 456–475 | 884–904 |
| 458 | 397–415 | 826–845 |
| 459 | 49–67 | 536–556 |
| 460 | 210–229 | 679–698 |
| 461 | 188–207 | 600–617 |
| 462 | 121–138 | 521–540 |
| 463 | 210–228 | 647–667 |
| 464 | 95–113 | 511–530 |
| 465 | 147–166 | 530–550 |
| 466 | 164–183 | 547–567 |
| 467 | 357–375 | 804–824 |
| 468 | 336–354 | 783–803 |
| 469 | 198–216 | 645–665 |
| 470 | 410–429 | 792–811 |
| 471 | 370–388 | 756–776 |
| 472 | 441–459 | 827–847 |
| 473 | 403–421 | 904–921 |
| 474 | 180–198 | 681–698 |
| 475 | 134–152 | 635–652 |
| 476 | 466–484 | 967–984 |
| 477 | 180–200 | 613–630 |
| 478 | 102–122 | 535–552 |
| 479 | 113–133 | 546–563 |
| 480 | 329–347 | 717–734 |
| 481 | 348–366 | 736–753 |
| 482 | 464–482 | 852–869 |
| 483 | 451–471 | 881–900 |
| 484 | 151–168 | 672–692 |
| 485 | 180–197 | 701–721 |
| 486 | 469–486 | 990–1010 |
| 487 | 1–20 | 429–448 |
| 488 | 1–20 | 429–448 |
| 489 | 1–20 | 429–448 |
| 491 | 1–18 | 332–351 |
| 492 | 1–18 | 332–351 |
| 493 | 1–18 | 402–421 |
| 494 | 1–19 | 402–420 |
| 495 | 1–19 | 402–420 |
| 496 | 1–19 | 402–420 |
| 497 | 1–20 | 409–428 |
| 498 | 1–20 | 413–431 |
| 499 | 1–19 | 403–422 |
| 500 | 1–19 | 427–446 |
| 501 | 1–18 | 408–427 |

TABLE 13-continued

Amplification primers

| SEQ ID NO. | POSITION RANGE OF AMPLIFICATION PRIMERS | COMPLEMENTARY POSITION RANGE OF AMPLIFICATION PRIMERS |
|---|---|---|
| 502 | 1–18 | 408–427 |
| 503 | 1–19 | 411–430 |
| 504 | 1–19 | 411–430 |
| 505 | 1–19 | 411–430 |
| 506 | 1–20 | 404–421 |
| 507 | 1–20 | 399–418 |
| 508 | 1–20 | 399–418 |
| 509 | 1–20 | 399–418 |
| 510 | 232–252 | 703–723 |
| 511 | 415–433 | 862–882 |
| 512 | 438–456 | 920–940 |
| 513 | 289–307 | 771–791 |
| 514 | 295–313 | 812–829 |
| 515 | 137–155 | 654–671 |
| 516 | 135–153 | 652–669 |
| 517 | 165–183 | 647–667 |
| 518 | 124–144 | 590–610 |
| 519 | 246–264 | 650–669 |
| 520 | 198–216 | 602–621 |
| 521 | 301–320 | 701–720 |
| 522 | 423–440 | 833–850 |
| 523 | 131–148 | 541–558 |
| 524 | 384–401 | 806–825 |
| 525 | 348–365 | 770–789 |
| 526 | 453–470 | 802–820 |
| 527 | 317–334 | 666–684 |
| 528 | 1–20 | 414–433 |
| 529 | 1–18 | 330–349 |
| 530 | 1–18 | 414–431 |
| 532 | 1–19 | 400–419 |
| 533 | 1–19 | 400–419 |
| 534 | 1–20 | 416–435 |
| 535 | 1–20 | 416–435 |
| 536 | 1–20 | 416–435 |
| 537 | 1–20 | 416–435 |
| 538 | 1–20 | 416–435 |
| 539 | 1–20 | 416–435 |
| 541 | 1–20 | 427–446 |
| 542 | 1–20 | 427–446 |
| 543 | 1–20 | 427–446 |
| 544 | 1–20 | 427–446 |
| 545 | 1–20 | 427–446 |
| 546 | 1–20 | 427–446 |
| 547 | 1–20 | 427–446 |
| 548 | 39–57 | 548–568 |
| 549 | 15–35 | 445–464 |
| 550 | 15–35 | 445–464 |
| 551 | 19–38 | 407–425 |
| 552 | 342–360 | 777–797 |
| 553 | 355–374 | 784–804 |
| 554 | 105–124 | 534–554 |
| 555 | 187–206 | 703–721 |
| 556 | 353–370 | 799–818 |
| 557 | 453–470 | 899–918 |
| 558 | 446–463 | 892–911 |
| 559 | 88–106 | 519–538 |
| 560 | 264–283 | 671–689 |
| 561 | 288–306 | 772–792 |
| 562 | 28–46 | 512–532 |
| 563 | 101–121 | 595–614 |
| 564 | 220–240 | 714–733 |
| 565 | 1–21 | 436–454 |
| 566 | 1–18 | 404–423 |
| 567 | 1–18 | 404–423 |
| 568 | 1–18 | 404–423 |
| 569 | 1–18 | 404–423 |
| 570 | 1–18 | 400–419 |
| 571 | 1–20 | 429–448 |
| 572 | 1–20 | 479–499 |
| 573 | 1–21 | 387–407 |
| 574 | 1–19 | 581–598 |
| 575 | 36–56 | 346–366 |
| 576 | 220–237 | 553–571 |
| 577 | 157–176 | 515–534 |
| 578 | 140–159 | 531–550 |
| 579 | 441–459 | 948–968 |
| 580 | 133–153 | 647–665 |
| 581 | 476–494 | 907–927 |
| 582 | 425–445 | 939–957 |
| 583 | 292–310 | 788–807 |
| 584 | 1–18 | 443–463 |
| 585 | 1–19 | 333–351 |
| 586 | 389–409 | 916–936 |
| 587 | 207–227 | 638–658 |
| 588 | 1–19 | 401–418 |
| 589 | 376–395 | 889–909 |
| 590 | 324–344 | 767–785 |
| 591 | 459–478 | 904–924 |
| 592 | 281–301 | 711–731 |
| 593 | 147–166 | 657–677 |
| 594 | 114–132 | 547–567 |
| 595 | 235–254 | 618–638 |
| 596 | 371–389 | 772–791 |
| 597 | 249–267 | 650–669 |
| 598 | 246–264 | 652–669 |
| 599 | 245–263 | 651–668 |
| 600 | 182–199 | 590–609 |
| 601 | 131–149 | 535–552 |
| 602 | 255–274 | 719–738 |
| 603 | 360–379 | 824–843 |
| 604 | 409–428 | 873–892 |
| 605 | 437–456 | 901–920 |
| 606 | 79–98 | 543–562 |
| 607 | 1–18 | 427–444 |
| 608 | 1–18 | 427–444 |
| 609 | 1–18 | 427–444 |
| 610 | 1–18 | 427–444 |
| 611 | 1–18 | 427–444 |
| 613 | 1–19 | 402–420 |
| 614 | 218–235 | 618–637 |
| 615 | 207–224 | 607–626 |
| 616 | 379–396 | 776–795 |
| 617 | 390–408 | 791–809 |
| 618 | 372–390 | 773–791 |
| 619 | 264–282 | 665–683 |
| 620 | 201–220 | 606–623 |
| 621 | 129–148 | 534–551 |
| 622 | 271–288 | 684–703 |
| 623 | 224–241 | 637–656 |
| 624 | 363–381 | 763–780 |
| 625 | 478–496 | 878–895 |
| 626 | 241–259 | 641–658 |
| 627 | 199–217 | 599–616 |
| 628 | 286–305 | 683–702 |
| 629 | 172–189 | 513–532 |
| 630 | 430–447 | 771–790 |
| 631 | 332–350 | 739–758 |
| 632 | 181–199 | 588–607 |
| 633 | 149–167 | 556–575 |
| 634 | 138–156 | 545–564 |
| 635 | 97–115 | 504–523 |
| 636 | 311–328 | 727–746 |
| 637 | 257–274 | 673–692 |
| 638 | 329–347 | 729–748 |
| 639 | 165–182 | 569–587 |
| 640 | 147–164 | 551–569 |
| 641 | 440–457 | 844–862 |
| 642 | 184–203 | 607–626 |
| 643 | 252–269 | 660–677 |
| 644 | 240–257 | 648–665 |
| 645 | 150–167 | 558–575 |
| 646 | 137–154 | 545–562 |

TABLE 13-continued

Amplification primers

| SEQ ID NO. | POSITION RANGE OF AMPLIFICATION PRIMERS | COMPLEMENTARY POSITION RANGE OF AMPLIFICATION PRIMERS |
|---|---|---|
| 647 | 402–420 | 722–740 |
| 648 | 378–396 | 630–648 |
| 649 | 309–327 | 561–579 |
| 650 | 431–449 | 885–903 |

TABLE 14

Preferred probes useful in genotyping eicosanoid-related biallelic markers by hybridization assays.

| SEQ ID NO. | POSITION RANGE OF PROBES |
|---|---|
| 1 | 466–490 |
| 2 | 466–490 |
| 3 | 466–490 |
| 4 | 466–490 |
| 5 | 466–490 |
| 6 | 466–490 |
| 7 | 466–490 |
| 8 | 466–490 |
| 9 | 466–490 |
| 10 | 466–490 |
| 11 | 466–490 |
| 12 | 466–490 |
| 13 | 466–490 |
| 14 | 466–490 |
| 15 | 466–490 |
| 16 | 466–490 |
| 17 | 466–490 |
| 18 | 466–490 |
| 19 | 466–490 |
| 20 | 466–490 |
| 21 | 466–490 |
| 22 | 466–490 |
| 23 | 466–490 |
| 24 | 466–490 |
| 25 | 466–490 |
| 26 | 466–490 |
| 27 | 466–490 |
| 28 | 466–490 |
| 29 | 466–490 |
| 30 | 466–490 |
| 31 | 466–490 |
| 32 | 466–490 |
| 33 | 466–490 |
| 34 | 466–490 |
| 35 | 466–490 |
| 36 | 466–490 |
| 37 | 466–490 |
| 38 | 466–490 |
| 39 | 466–490 |
| 40 | 466–490 |
| 41 | 466–490 |
| 42 | 466–490 |
| 43 | 466–490 |
| 44 | 107–131 |
| 45 | 231–255 |
| 46 | 116–140 |
| 47 | 466–490 |
| 48 | 23–47 |
| 49 | 117–141 |
| 50 | 139–163 |
| 51 | 346–370 |
| 52 | 454–478 |
| 53 | 406–430 |
| 54 | 217–241 |
| 55 | 243–267 |
| 56 | 466–490 |
| 57 | 290–314 |
| 58 | 167–191 |
| 59 | 195–219 |
| 60 | 528–552 |
| 61 | 154–178 |
| 62 | 443–467 |
| 63 | 320–344 |
| 64 | 339–363 |
| 65 | 352–376 |
| 66 | 87–111 |
| 67 | 135–159 |
| 68 | 253–277 |
| 69 | 488–512 |
| 70 | 489–513 |
| 72 | 489–513 |
| 73 | 489–513 |
| 74 | 489–513 |
| 75 | 489–513 |
| 76 | 489–513 |
| 77 | 489–513 |
| 78 | 489–513 |
| 79 | 489–513 |
| 80 | 489–513 |
| 81 | 489–513 |
| 82 | 489–513 |
| 83 | 489–513 |
| 84 | 489–513 |
| 85 | 488–512 |
| 86 | 489–513 |
| 87 | 489–513 |
| 88 | 489–513 |
| 89 | 489–513 |
| 90 | 489–513 |
| 91 | 489–513 |
| 92 | 489–513 |
| 93 | 489–513 |
| 94 | 489–513 |
| 95 | 489–513 |
| 96 | 489–513 |
| 97 | 246–270 |
| 98 | 489–513 |
| 99 | 431–455 |
| 100 | 301–325 |
| 101 | 489–513 |
| 102 | 489–513 |
| 103 | 489–513 |
| 104 | 489–513 |
| 105 | 373–397 |
| 106 | 489–513 |
| 107 | 489–513 |
| 108 | 368–392 |
| 109 | 311–335 |
| 110 | 305–329 |
| 111 | 489–513 |
| 112 | 489–513 |
| 113 | 489–513 |
| 114 | 489–513 |
| 115 | 489–513 |
| 116 | 217–241 |
| 117 | 474–498 |
| 118 | 489–513 |
| 119 | 489–513 |
| 120 | 489–513 |
| 121 | 489–513 |
| 122 | 489–513 |
| 123 | 489–513 |
| 124 | 489–513 |
| 125 | 489–513 |
| 126 | 485–509 |
| 127 | 489–513 |
| 128 | 489–513 |
| 129 | 489–513 |
| 130 | 489–513 |
| 131 | 489–513 |

TABLE 14-continued

Preferred probes useful in genotyping eicosanoid-related biallelic markers by hybridization assays.

| SEQ ID NO. | POSITION RANGE OF PROBES |
|---|---|
| 132 | 489–513 |
| 133 | 489–513 |
| 134 | 489–513 |
| 135 | 489–513 |
| 136 | 489–513 |
| 137 | 489–513 |
| 138 | 489–513 |
| 139 | 489–513 |
| 140 | 489–513 |
| 141 | 489–513 |
| 142 | 489–513 |
| 143 | 489–513 |
| 144 | 489–513 |
| 145 | 489–513 |
| 146 | 489–513 |
| 147 | 489–513 |
| 148 | 489–513 |
| 149 | 489–513 |
| 150 | 489–513 |
| 151 | 489–513 |
| 152 | 489–513 |
| 153 | 489–513 |
| 154 | 489–513 |
| 155 | 489–513 |
| 156 | 489–513 |
| 157 | 489–513 |
| 158 | 489–513 |
| 159 | 489–513 |
| 160 | 489–513 |
| 161 | 489–513 |
| 162 | 489–513 |
| 163 | 489–513 |
| 164 | 496–520 |
| 165 | 489–513 |
| 166 | 489–513 |
| 167 | 489–513 |
| 168 | 489–513 |
| 169 | 489–513 |
| 170 | 489–513 |
| 171 | 489–513 |
| 172 | 489–513 |
| 173 | 489–513 |
| 174 | 489–513 |
| 175 | 489–513 |
| 176 | 489–513 |
| 177 | 489–513 |
| 178 | 489–513 |
| 179 | 529–553 |
| 180 | 489–513 |
| 181 | 489–513 |
| 182 | 489–513 |
| 183 | 489–513 |
| 184 | 489–513 |
| 185 | 489–513 |
| 186 | 489–513 |
| 187 | 489–513 |
| 188 | 489–513 |
| 189 | 489–513 |
| 190 | 489–513 |
| 191 | 489–513 |
| 192 | 489–513 |
| 193 | 489–513 |
| 194 | 489–513 |
| 195 | 489–513 |
| 196 | 489–513 |
| 197 | 489–513 |
| 198 | 489–513 |
| 199 | 489–513 |
| 200 | 489–513 |
| 201 | 489–513 |
| 202 | 489–513 |
| 203 | 489–513 |
| 204 | 489–513 |
| 205 | 489–513 |
| 206 | 489–513 |
| 207 | 489–513 |
| 208 | 489–513 |
| 209 | 489–513 |
| 210 | 489–513 |
| 211 | 489–513 |
| 212 | 489–513 |
| 213 | 489–513 |
| 214 | 489–513 |
| 215 | 489–513 |
| 216 | 489–513 |
| 217 | 489–513 |
| 218 | 489–513 |
| 219 | 489–513 |
| 220 | 489–513 |
| 221 | 489–513 |
| 222 | 60–84 |
| 223 | 61–85 |
| 224 | 67–91 |
| 225 | 126–150 |
| 226 | 69–93 |
| 227 | 29–53 |
| 228 | 23–47 |
| 229 | 262–286 |
| 230 | 121–145 |
| 231 | 185–209 |
| 232 | 186–210 |
| 233 | 350–374 |
| 234 | 375–399 |
| 235 | 397–421 |
| 236 | 295–319 |
| 237 | 235–259 |
| 238 | 282–306 |
| 239 | 335–359 |
| 240 | 92–116 |
| 241 | 311–335 |
| 242 | 391–415 |
| 243 | 86–110 |
| 244 | 276–300 |
| 245 | 368–392 |
| 246 | 148–172 |
| 247 | 194–218 |
| 248 | 271–295 |
| 249 | 305–329 |
| 250 | 489–513 |
| 251 | 489–513 |
| 252 | 489–513 |
| 253 | 489–513 |
| 254 | 489–513 |
| 255 | 509–533 |
| 256 | 489–513 |
| 257 | 489–513 |
| 258 | 489–513 |
| 259 | 489–513 |
| 260 | 489–513 |
| 261 | 489–513 |
| 262 | 489–513 |
| 263 | 488–512 |
| 264 | 489–513 |
| 265 | 489–513 |
| 266 | 489–513 |
| 267 | 489–513 |
| 268 | 489–513 |
| 269 | 489–513 |
| 270 | 489–513 |
| 271 | 489–513 |
| 272 | 489–513 |
| 273 | 489–513 |
| 274 | 489–513 |
| 275 | 490–514 |
| 276 | 489–513 |
| 277 | 471–495 |

TABLE 14-continued

Preferred probes useful in genotyping eicosanoid-related biallelic markers by hybridization assays.

| SEQ ID NO. | POSITION RANGE OF PROBES |
|---|---|
| 278 | 489–513 |
| 279 | 489–513 |
| 280 | 488–512 |
| 281 | 464–488 |
| 282 | 486–510 |
| 283 | 489–513 |
| 284 | 489–513 |
| 285 | 489–513 |
| 286 | 489–513 |
| 287 | 489–513 |
| 288 | 433–457 |
| 289 | 489–513 |
| 290 | 487–511 |
| 291 | 489–513 |
| 292 | 489–513 |
| 293 | 489–513 |
| 294 | 489–513 |
| 295 | 489–513 |
| 296 | 489–513 |
| 297 | 489–513 |
| 298 | 489–513 |
| 299 | 367–391 |
| 300 | 374–398 |
| 301 | 489–513 |
| 302 | 489–513 |
| 303 | 489–513 |
| 304 | 489–513 |
| 305 | 427–451 |
| 306 | 266–290 |
| 307 | 314–338 |
| 308 | 326–350 |
| 309 | 401–425 |
| 310 | 489–513 |
| 311 | 489–513 |
| 312 | 489–513 |
| 313 | 489–513 |
| 314 | 489–513 |
| 315 | 489–513 |
| 316 | 489–513 |
| 317 | 489–513 |
| 318 | 489–513 |
| 319 | 489–513 |
| 320 | 489–513 |
| 321 | 489–513 |
| 322 | 489–513 |
| 323 | 489–513 |
| 324 | 374–398 |
| 325 | 228–252 |
| 326 | 264–288 |
| 327 | 30–54 |
| 328 | 329–353 |
| 329 | 252–276 |
| 330 | 266–290 |
| 331 | 164–188 |
| 332 | 102–126 |
| 333 | 164–188 |
| 334 | 230–254 |
| 335 | 338–362 |
| 336 | 30–54 |
| 337 | 362–386 |
| 338 | 247–271 |
| 339 | 489–513 |
| 340 | 489–513 |
| 341 | 489–513 |
| 342 | 489–513 |
| 343 | 489–513 |
| 344 | 489–513 |
| 345 | 489–513 |
| 346 | 489–513 |
| 347 | 489–513 |
| 348 | 489–513 |
| 349 | 489–513 |
| 350 | 464–488 |
| 351 | 489–513 |
| 352 | 489–513 |
| 353 | 489–513 |
| 354 | 489–513 |
| 355 | 489–513 |
| 356 | 489–513 |
| 357 | 489–513 |
| 358 | 489–513 |
| 359 | 489–513 |
| 360 | 489–513 |
| 361 | 489–513 |
| 362 | 489–513 |
| 363 | 489–513 |
| 364 | 489–513 |
| 365 | 489–513 |
| 366 | 489–513 |
| 367 | 489–513 |
| 368 | 489–513 |
| 369 | 489–513 |
| 370 | 489–513 |
| 371 | 489–513 |
| 372 | 489–513 |
| 373 | 489–513 |
| 374 | 489–513 |
| 375 | 489–513 |
| 376 | 489–513 |
| 377 | 489–513 |
| 378 | 489–513 |
| 379 | 489–513 |
| 380 | 489–513 |
| 381 | 489–513 |
| 382 | 489–513 |
| 383 | 489–513 |
| 384 | 489–513 |
| 385 | 489–513 |
| 386 | 489–513 |
| 387 | 489–513 |
| 388 | 489–513 |
| 389 | 489–513 |
| 390 | 489–513 |
| 391 | 489–513 |
| 392 | 489–513 |
| 393 | 489–513 |
| 394 | 467–491 |
| 395 | 489–513 |
| 396 | 489–513 |
| 397 | 489–513 |
| 398 | 489–513 |
| 399 | 489–513 |
| 400 | 516–540 |
| 401 | 489–513 |
| 402 | 489–513 |
| 403 | 489–513 |
| 404 | 489–513 |
| 405 | 489–513 |
| 406 | 489–513 |
| 407 | 489–513 |
| 408 | 489–513 |
| 409 | 489–513 |
| 410 | 33–57 |
| 411 | 51–75 |
| 412 | 165–189 |
| 413 | 390–414 |
| 414 | 124–148 |
| 415 | 128–152 |
| 416 | 27–51 |
| 417 | 53–77 |
| 418 | 245–269 |
| 425 | 357–381 |
| 426 | 23–47 |
| 427 | 90–114 |
| 428 | 112–136 |
| 429 | 171–195 |

TABLE 14-continued

Preferred probes useful in genotyping eicosanoid-related biallelic markers by hybridization assays.

| SEQ ID NO. | POSITION RANGE OF PROBES |
|---|---|
| 430 | 370–394 |
| 431 | 21–45 |
| 432 | 138–162 |
| 433 | 210–234 |
| 434 | 238–262 |
| 435 | 342–366 |
| 436 | 30–54 |
| 437 | 144–168 |
| 438 | 214–238 |
| 439 | 489–513 |
| 440 | 489–513 |
| 441 | 489–513 |
| 442 | 489–513 |
| 443 | 489–513 |
| 444 | 489–513 |
| 445 | 489–513 |
| 446 | 489–513 |
| 447 | 489–513 |
| 448 | 489–513 |
| 449 | 489–513 |
| 450 | 489–513 |
| 451 | 489–513 |
| 452 | 489–513 |
| 453 | 489–513 |
| 454 | 489–513 |
| 455 | 489–513 |
| 456 | 489–513 |
| 457 | 489–513 |
| 458 | 489–513 |
| 459 | 489–513 |
| 460 | 489–513 |
| 461 | 489–513 |
| 462 | 489–513 |
| 463 | 489–513 |
| 464 | 489–513 |
| 465 | 489–513 |
| 466 | 489–513 |
| 467 | 489–513 |
| 468 | 489–513 |
| 469 | 489–513 |
| 470 | 489–513 |
| 471 | 489–513 |
| 472 | 489–513 |
| 473 | 489–513 |
| 474 | 489–513 |
| 475 | 489–513 |
| 476 | 489–513 |
| 477 | 489–513 |
| 478 | 489–513 |
| 479 | 489–513 |
| 480 | 489–513 |
| 481 | 489–513 |
| 482 | 489–513 |
| 483 | 489–513 |
| 484 | 489–513 |
| 485 | 489–513 |
| 486 | 489–513 |
| 487 | 127–151 |
| 488 | 200–224 |
| 489 | 229–253 |
| 491 | 173–197 |
| 492 | 252–276 |
| 493 | 10–34 |
| 494 | 140–164 |
| 495 | 244–268 |
| 496 | 270–294 |
| 497 | 269–293 |
| 498 | 130–154 |
| 499 | 290–314 |
| 500 | 319–343 |
| 501 | 140–164 |
| 502 | 246–270 |
| 503 | 91–115 |
| 504 | 132–156 |
| 505 | 263–287 |
| 506 | 215–239 |
| 507 | 143–167 |
| 508 | 369–393 |
| 509 | 86–110 |
| 510 | 489–513 |
| 511 | 489–513 |
| 512 | 489–513 |
| 513 | 489–513 |
| 514 | 489–513 |
| 515 | 489–513 |
| 516 | 489–513 |
| 517 | 489–513 |
| 518 | 489–513 |
| 519 | 489–513 |
| 520 | 489–513 |
| 521 | 489–513 |
| 522 | 489–513 |
| 523 | 489–513 |
| 524 | 489–513 |
| 525 | 489–513 |
| 526 | 489–513 |
| 527 | 489–513 |
| 528 | 315–339 |
| 529 | 40–64 |
| 530 | 34–58 |
| 532 | 98–122 |
| 533 | 261–285 |
| 534 | 78–102 |
| 535 | 192–216 |
| 536 | 209–233 |
| 537 | 222–246 |
| 538 | 276–300 |
| 539 | 299–323 |
| 541 | 27–51 |
| 542 | 108–132 |
| 543 | 142–166 |
| 544 | 89–113 |
| 545 | 74–98 |
| 546 | 80–104 |
| 547 | 82–106 |
| 548 | 489–513 |
| 549 | 404–428 |
| 550 | 76–100 |
| 551 | 275–299 |
| 552 | 427–451 |
| 553 | 489–513 |
| 554 | 489–513 |
| 555 | 489–513 |
| 556 | 489–513 |
| 557 | 489–513 |
| 558 | 489–513 |
| 559 | 489–513 |
| 560 | 489–513 |
| 561 | 489–513 |
| 562 | 489–513 |
| 563 | 489–513 |
| 564 | 489–513 |
| 565 | 238–262 |
| 566 | 73–97 |
| 567 | 39–63 |
| 568 | 195–219 |
| 569 | 385–409 |
| 570 | 207–231 |
| 596 | 489–513 |
| 597 | 489–513 |
| 598 | 489–513 |
| 599 | 489–513 |
| 601 | 489–513 |
| 602 | 489–513 |
| 603 | 489–513 |
| 604 | 489–513 |

TABLE 14-continued

Preferred probes useful in genotyping eicosanoid-related biallelic markers by hybridization assays.

| SEQ ID NO. | POSITION RANGE OF PROBES |
|---|---|
| 605 | 489–513 |
| 607 | 129–153 |
| 608 | 146–170 |
| 609 | 255–279 |
| 610 | 325–349 |
| 611 | 354–378 |
| 612 | 405–429 |
| 614 | 489–513 |
| 616 | 489–513 |
| 617 | 489–513 |
| 618 | 489–513 |
| 619 | 489–513 |
| 621 | 489–513 |
| 623 | 489–513 |
| 624 | 489–513 |
| 625 | 488–512 |
| 626 | 489–513 |
| 627 | 489–513 |
| 629 | 489–513 |
| 630 | 489–513 |
| 631 | 489–513 |
| 632 | 489–513 |
| 633 | 489–513 |
| 634 | 489–513 |
| 635 | 489–513 |
| 636 | 489–513 |
| 637 | 489–513 |
| 640 | 489–513 |
| 641 | 489–513 |
| 642 | 489–513 |
| 643 | 489–513 |
| 644 | 489–513 |
| 645 | 489–513 |
| 646 | 489–513 |
| 647 | 489–513 |
| 648 | 489–513 |
| 649 | 489–513 |
| 650 | 489–513 |

SEQUENCE LISTING INFORMATION

The Sequence Listing for this application is on duplicate compact discs labeled "Copy 1" and "Copy 2." Copy 1 and Copy 2 each contain only one file named "Sequence-List.txt" which was created on Jun. 10, 2002, and is 1,243 KB. The entire contents of each of the computer discs are incorporated herein by reference in their entireties.

TABLE 15

HAPLOTYPE FREQUENCY ANALYSIS

| MARKERS FLAP | 10-253-298 5' gene | 10-33-175 exon 2 | 10-33-234 intron 2 | 10-33-327 | 10-35-358 intron 4 | 10-35-390 | 12-628-306 3' gene | 12-629-241 |
|---|---|---|---|---|---|---|---|---|
| cases/controls | 287/186 | 295/174 | 295/274 | 295/270 | 291/280 | 295/272 | 284/185 | 283/182 |
| freq % case/controls | 95/95 (C) | 99/98 (C) | 49/44 (A) | 78/76 (T) | 72/69 (G) | 31/23 (C) | 88/90 (C) | 76/72 (G) |
| diff. freq. all. (cases - controls) | 0.5 | 1.8 | 5.3 | 2.6 | 3.4 | 9 | 2.1 | 4.6 |
| p value | 6.55E-01 | 1.35E-02 | 6.93E-02 | 2.94E-01 | 2.06E-01 | 2.29E-03 | 3.17E-01 | 1.14E-01 |

| | | | | | | | | | | Frequencies haplotype | | | | |
|---|---|---|---|---|---|---|---|---|---|---|---|---|---|---|
| | | | | | | | | | | | ESTIMATED FREQUENCIES | | | |
| | 293 vs 265 | | | A | | | | | | cases | controls | Odds ratio | Chi-S | P value (1 df) |
| 1 | 293 vs 265 | | | A | | | T | | | 0.283 | 0.197 | 1.61 | 11.18 | (8.2e-04) |
| 2 | 281 vs 177 | | | A | T | | | | G | 0.305 | 0.210 | 1.65 | 9.97 | (1.6e-03) |
| 3 | 293 vs 261 | | | | T | | T | | | 0.307 | 0.224 | 1.53 | 9.62 | (1.8e-03) |
| 4 | 289 vs 271 | | | | | G | T | | | 0.304 | 0.231 | 1.46 | 7.77 | (5.2e-03) |
| 5 | 293 vs 168 | | C | | | | T | | | 0.309 | 0.226 | 1.53 | 7.26 | (6.9e-03) |
| 6 | 293 vs 265 | | | A | T | | | | | 0.276 | 0.208 | 1.46 | 7.17 | (7.3e-03) |
| 7 | 282 vs 178 | | | | | | T | | G | 0.314 | 0.233 | 1.50 | 7.01 | (7.7e-03) |
| 37 | 281 vs 176 | | | A | | | T | C | | 0.265 | 0.171 | 1.76 | 11.04 | (8.6e-04) |
| 38 | 280 vs 173 | | | A | | | T | | G | 0.292 | 0.194 | 1.71 | 10.71 | (1.0e-03) |
| 39 | 289 vs 264 | | | A | | G | T | | | 0.283 | 0.199 | 1.59 | 10.56 | (1.1e-03) |
| 40 | 278 vs 175 | | | A | | | T | C | G | 0.271 | 0.180 | 1.70 | 9.94 | (1.6e-03) |
| 41 | 284 vs 176 | | | A | | | T | | | 0.287 | 0.195 | 1.66 | 9.77 | (1.7e-03) |
| 121 | 277 vs 171 | C | | A | | | T | C | | 0.265 | 0.169 | 1.77 | 11.07 | (8.6e-04) |
| 122 | 278 vs 173 | | | A | | G | T | | G | 0.290 | 0.195 | 1.69 | 10.29 | (1.3e-03) |
| 123 | 279 vs 176 | | | A | | G | T | C | | 0.264 | 0.175 | 1.70 | 9.80 | (1.7e-03) |
| 124 | 276 vs 175 | | | A | | G | | C | G | 0.271 | 0.181 | 1.69 | 9.72 | (1.7e-03) |
| 125 | 280 vs 174 | C | | A | | | T | C | G | 0.265 | 0.176 | 1.69 | 9.68 | (1.8e-03) |
| 247 | 275 vs 171 | | | A | | G | T | C | G | 0.265 | 0.170 | 1.77 | 10.91 | (9.1e-04) |
| 248 | 276 vs 169 | C | | A | | G | T | C | G | 0.265 | 0.172 | 1.74 | 10.30 | (1.3e-03) |
| 373 | 274 vs 169 | C | | A | | G | T | C | G | 0.265 | 0.172 | 1.73 | 10.13 | (1.4e-03) |
| 457 | 273 vs 163 | C | | A | T | G | T | C | G | 0.247 | 0.167 | 1.64 | 7.74 | (5.2e-03) |

TABLE 16

HAPLOTYPE FREQUENCY ANALYSIS
PERMUTATIONS TEST RESULTS (>1000 Iterations)

| | Markers | 10-33-234 intron 2 | | 10-35-390 intron 4 | |
|---|---|---|---|---|---|
| | ALT vs US cases vs US controls ASSOCIATION | A | | T | |
| | | 5.3 (51 vs 56) diff all. Freq | 6.93E−02 p value | 9 (31 vs 23) diff all. Freq | 2.29E−03 p value |

| HAPLOTYPE (AT) | sample sizes | haplotype frequencies | | p-excess | odds-ratio | chi-S | P value | PERMUTATIONS TEST RESULTS | | |
|---|---|---|---|---|---|---|---|---|---|---|
| | cases vs controls | cases | controls | | | | | Av. Chi-S | Max Chi-S | >Iter/ nb of Iter. |
| Asthmatics vs US controls | 293 vs 265 | 0.283 | 0.197 | 10.7 | 1.61 | 11.18 | 8.20E−04 | 1.2 / 1.2 | 7.4 / 12.9 | 0/1000 / 1/10000 |

TABLE 17

HAPLOTYPE FREQUENCY ANALYSIS
(Asthma)
297 Asthmatics vs 186 US controls randoms

| MARKERS 12-lipoxygenase | 12-208-35 | 12-226-167 | 12-206-366 | 10-347-203 | 10-347-220 | 10-349-97 | 10-349-224 |
|---|---|---|---|---|---|---|---|
| | 5' gene | | intron 2 | exon 6 | | exon 8 | |
| cases/controls | 284/182 | 288/188 | 272/89 | 285/184 | 274/184 | 282/182 | 271/177 |
| frequency % (case/controls) | 59/58 (T) | 62/59 (C) | 57/62 (T) | 57/58 (A) | 58/60 (G) | 59/60 (A) | 57/60 (G) |
| diff freq. all. (cases controls) | 0.9 | 3.4 | −4.6 | −1.2 | −1.7 | −1.9 | −3.1 |
| p value | 7.52e−01 * | 2.94e−01 * | 2.73e−01 * | 6.55e−01 * | 5.84e−01 * | 5.27e−01 * | 3.43e−01 * |

| | | | | | | | | |
|---|---|---|---|---|---|---|---|---|
| 1 | 268 vs 176 | | | | | | G | |
| 2 | 277 vs 174 | | | | | | | A |
| 3 | 274 vs 179 | | | | | | G | |
| 4 | 282 vs 176 | | | | | | | A |
| 5 | 280 vs 176 | | | | A | | | |
| 6 | 285 vs 178 | | | | A | | | |
| 7 | 270 vs 176 | | C | | | | | T |
| 8 | 247 vs 86 | | | C | | A | | T |
| 9 | 255 vs 85 | | | C | G | | | T |
| 10 | 253 vs 84 | | | C | | | G | T |
| 11 | 267 vs 172 | A | | | | | | T |
| 12 | 281 vs 181 | | C | | | | G | |
| 13 | 274 vs 182 | | C | | | A | | |
| 14 | 278 vs 174 | | | | A | | | |
| 15 | 267 vs 175 | | | | | | G | |
| 16 | 276 vs 173 | | | | | | A | |
| 17 | 273 vs 172 | | | | A | | | |
| 18 | 268 vs 172 | | | | | G | | |
| 19 | 261 vs 172 | | | | | G | | |
| 20 | 271 vs 171 | | | | | | A | |
| 21 | 277 vs 169 | | | | | | A | |
| 22 | 280 vs 171 | | | | A | | | |
| 23 | 264 vs 170 | | | | | G | A | |
| 24 | 264 vs 81 | T | | C | | | G | |

| MARKERS 12-lipoxygenase | 12-196-119 | 12-214-129 | 12-216-421 | 12-219-230 | 12-223-207 | | | | |
|---|---|---|---|---|---|---|---|---|---|
| cases/controls | 281/184 | 282/181 | 288/182 | 288/187 | 287/186 | | | | |
| frequency % (case/controls) | 70/71 (T) | 61/61 (T) | 61/64 (G) | 64/68 (A) | 62/62 (T) | | | | |
| diff freq. all. (cases controls) | −1.2 | −0.7 | −2.9 | −4.2 | 0.8 | ESTIMATED FREQUENCIES | | | |
| p value | 6.55e−01 * | 7.52e−01 * | 3.71e−01 * | 1.80e−01 | 7.52e−01 * | haplotype frequencies | | Odds | |
| | | | | | | cases controls | p-excess | ratio Chi-S | P value (1 df) |
| 1 | 268 vs 176 | C | | G | | 0.123 0.040 | 8.63 | 3.38 17.85 | (2.3e−05) |
| 2 | 277 vs 174 | C | | G | | 0.125 0.041 | 8.71 | 3.31 17.75 | (2.5e−05) |
| 3 | 274 vs 179 | | A | G | | 0.123 0.041 | 8.49 | 3.26 17.47 | (2.9e−05) |
| 4 | 282 vs 176 | | A | G | | 0.125 0.043 | 8.57 | 3.20 17.29 | (3.2e−05) |
| 5 | 280 vs 176 | C | | G | | 0.115 0.037 | 8.08 | 3.36 16.81 | (3.9e−05) |
| 6 | 285 vs 178 | | A | G | | 0.113 0.039 | 7.73 | 3.16 15.62 | (7.4e−05) |

TABLE 17-continued

HAPLOTYPE FREQUENCY ANALYSIS
(Asthma)
297 Asthmatics vs 186 US controls randoms

| | | | | | | | | | | | | |
|---|---|---|---|---|---|---|---|---|---|---|---|---|
| 7 | 270 vs 176 | | | | | T | 0.130 | 0.055 | 7.98 | 2.58 | 13.40 | (2.5e−04) |
| 8 | 247 vs 86 | | | | | | 0.405 | 0.256 | 19.96 | 1.97 | 12.10 | (5.0e−04) |
| 9 | 255 vs 85 | | | | | | 0.406 | 0.259 | 19.81 | 1.95 | 11.80 | (5.6e−04) |
| 10 | 253 vs 84 | | | | | | 0.399 | 0.253 | 19.62 | 1.97 | 11.73 | (5.9e−04) |
| 11 | 267 vs 172 | | | | | T | 0.088 | 0.030 | 5.97 | 3.09 | 11.45 | (7.0e−04) |
| 12 | 281 vs 181 | | | | | T | 0.136 | 0.066 | 7.50 | 2.22 | 11.10 | (8.6e−04) |
| 13 | 274 vs 182 | | | | | T | 0.137 | 0.067 | 7.52 | 2.21 | 11.05 | (8.6e−04) |
| 14 | 278 vs 174 | T | | A | G | | 0.118 | 0.031 | 9.01 | 4.18 | 21.01 | (4.4e−06) |
| 15 | 267 vs 175 | T | | A | G | | 0.124 | 0.035 | 9.27 | 3.92 | 20.87 | (4.8e−06) |
| 16 | 276 vs 173 | T | | A | G | | 0.124 | 0.035 | 9.23 | 3.91 | 20.65 | (5.4e−06) |
| 17 | 273 vs 172 | T | C | | G | | 0.121 | 0.034 | 9.01 | 3.90 | 20.02 | (7.3e−06) |
| 18 | 268 vs 172 | | C | A | G | | 0.124 | 0.036 | 9.14 | 3.76 | 19.84 | (8.2e−06) |
| 19 | 261 vs 172 | T | C | | G | | 0.126 | 0.037 | 9.20 | 3.74 | 19.81 | (8.2e−06) |
| 20 | 271 vs 171 | T | C | | G | | 0.125 | 0.037 | 9.11 | 3.69 | 19.49 | (1.0e−05) |
| 21 | 277 vs 169 | | C | A | G | | 0.125 | 0.038 | 9.06 | 3.64 | 19.10 | (1.2e−05) |
| 22 | 280 vs 171 | | C | A | G | | 0.116 | 0.033 | 8.56 | 3.81 | 18.76 | (1.5e−05) |
| 23 | 264 vs 170 | | C | | G | | 0.125 | 0.040 | 8.91 | 3.45 | 18.15 | (2.0e−05) |
| 24 | 264 vs 81 | | | G | | | 0.197 | 0.056 | 14.96 | 4.13 | 18.01 | (2.1e−05) |

TABLE 18A

ALLELE FREQUENCY ANALYSIS
(Asthma)
CASES (297 ALT) vs CONTROLS (186 US CAUCASIAN)

| MARKERS PROTEIN 12-LO | 12-197/244 | 12-208/35 5' gene | 12-226/167 | 12-206/366 In2 | 10-346/141 ex5 |
|---|---|---|---|---|---|
| cases/controls | 277/180 | 284/182 | 288/188 | 272/89 | 285/185 |
| frequency % (case/controls) | 66/67 (T) | 58/57 (T) | 62/58 (C) | 57/61 (T) | 99/100 (G) |
| diff freq. all. (cases − controls) | −1.0 | 0.9 | 3.4 | −4.6 | −0.4 |
| p value | 7.52e−01 * | 7.52e−01 * | 2.94e−01 * | 2.73e−01 * | HOM |
| Test Hardy Weinberg cases vs controls | 0.034 (HWD) 0.054 (HWD) | −0.002 (HWE) −0.020 (HWE) | −0.001 (HWE) 0.022 (HWE) | −0.014 (HWE) 0.000 (HWE) | 0.000 (HWD) 0.000 (HWD) |

| MARKERS PROTEIN 12-LO | 10-347/111 | 10-347/165 ex6 | 10-347/203 | 10-347/220 | 10-349/97 | 10-349/224 ex8 |
|---|---|---|---|---|---|---|
| cases/controls | 284/180 | 268/185 | 280/184 | 283/184 | 287/182 | 277/177 |
| frequency % (case/controls) | 99/100 (G) | 99/100 (C) | 57/58 (A) | 57/59 (G) | 59/60 (A) | 56/60 (G) |
| diff freq. all. (cases − controls) | −0.2 | −0.2 | −1.1 | −2.1 | −1.4 | −4.1 |
| p value | HOM | 5.92e−01# | 6.55e−01 * | 4.80e−01 * | 6.55e−01 * | 2.06e−01 * |
| Test Hardy Weinberg cases vs controls | 0.000 (HWD) 0.000 (HWD) | 0.000 (HWD) 0.000 (HWD) | −0.011 (HWE) 0.012 (HWE) | −0.005 (HWE) 0.021 (HWE) | 0.003 (HWE) 0.008 (HWE) | −0.010 (HWE) −0.004 (HWE) |

| MARKERS PROTEIN 12-LO | 10-341/116 ex14 | 12-196/119 | 12-214/129 | 12-216/421 markers in bac | 12-219/230 | 12-223/207 |
|---|---|---|---|---|---|---|
| cases/controls | 286/176 | 281/184 | 282/181 | 288/182 | 288/187 | 287/186 |
| frequency % (case/controls) | 89/89 (G) | 69/70 (T) | 60/61 (T) | 61/64 (G) | 63/67 (A) | 62/61 (T) |
| diff freq. all. (cases − controls) | 0.1 | −1.2 | −0.7 | −2.9 | −4.2 | 0.8 |
| p value | 7.52e−01 * | 6.55e−01 * | 7.52e−01 * | 3.71e−01 * | 1.80e−01 * | 7.52e−01 * |
| Test Hardy Weinberg cases vs controls | −0.008 (HWE) −0.000 (HWE) | 0.012 (HWE) 0.030 (HWE) | −0.013 (HWE) 0.016 (HWE) | −0.012 (HWE) 0.024 (HWE) | −0.010 (HWE) −0.001 (HWE) | 0.012 (HWD) −0.019 (HWD) |

TABLE 18B

HAPLOTYPE FREQUENCY ANALYSIS
(Asthma)
CASES (297 ALT) vs CONTROLS (186 US CAUCASIAN)

| | | | | | | | Haplotype frequencies | | ESTIMATED FREQUENCIES | | | | PERMUTATIONS TEST RESULTS | | |
|---|---|---|---|---|---|---|---|---|---|---|---|---|---|---|---|
| | | | Marker 1 | Marker 2 | Marker 3 | Marker 4 | Haplotype | cases | controls | p-excess | Odds ratio | Chi-S | P value (1 df) | Av. Chi-S | Max Chi-s | >Iter/ nb of Iter |
| haplotype 1 | PT2 | 265 vs 86 | 12-206/366 | 10-349/224 | | | CT | 0.424 | 0.265 | 21.72 | 2.05 | 13.97 | (1.8e-04) **** | 2.1 | 8.3 | [0/100] |
| haplotype 2 | PT2 | 267 vs 89 | 12-206/366 | 10-347/220 | | | CA | 0.423 | 0.274 | 20.56 | 1.94 | 12.55 | (3.9e-04) *** | 2.3 | 9.3 | [0/100] |
| haplotype 3 | PT2 | 266 vs 88 | 12-206/366 | 10-347/203 | | | CG | 0.421 | 0.277 | 19.96 | 1.90 | 11.64 | (6.3e-04) *** | 2.1 | 7.1 | [0/100] |
| haplotype 4 | PT2 | 271 vs 87 | 12-206/366 | 10-349/97 | | | CG | 0.408 | 0.270 | 18.88 | 1.86 | 10.69 | (1.1e-03) *** | 1.7 | 5.9 | [0/100] |
| haplotype 5 | PT2 | 271 vs 174 | 12-197/244 | 12-214/129 | | | CC | 0.148 | 0.077 | 7.66 | 2.08 | 10.03 | (1.5e-03) *** | 1.8 | 9.7 | [0/100] |
| haplotype 6 | PT2 | 285 vs 175 | 10-341/116 | 12-223/207 | | | AT | 0.042 | 0.008 | 3.45 | 5.48 | 8.95 | (2.7e-03) *** | 1.4 | 9.9 | [2/100] |
| haplotype 7 | PT3 | 282 vs 174 | 10-349/97 | 12-214/129 | 12-219/230 | | ACG | 0.125 | 0.041 | 8.73 | 3.32 | 17.87 | (2.3e-05) ***** | 1.8 | 8.5 | [0/100] |
| haplotype 8 | PT3 | 287 vs 176 | 10-349/97 | 12-216/421 | 12-219/230 | | AAG | 0.126 | 0.043 | 8.67 | 3.23 | 17.65 | (2.6e-05) ***** | 1.5 | 13.6 | [0/100] |
| haplotype 9 | PT3 | 277 vs 176 | 10-347/220 | 12-214/129 | 12-219/230 | | GCG | 0.119 | 0.040 | 8.28 | 3.27 | 16.90 | (3.7e-05) ***** | 3.0 | 15.4 | [0/100] |
| haplotype 10 | PT3 | 275 vs 176 | 10-347/203 | 12-214/129 | 12-219/230 | | ACG | 0.115 | 0.037 | 8.05 | 3.35 | 16.64 | (4.4e-05) **** | 2.4 | 19.2 | [1/100] |
| haplotype 11 | PT3 | 283 vs 179 | 10-347/220 | 12-214/129 | 12-219/230 | | GAG | 0.119 | 0.041 | 8.11 | 3.15 | 16.40 | (5.1e-05) **** | 2.6 | 14.4 | [0/100] |
| haplotype 12 | PT3 | 266 vs 171 | 12-197/244 | 12-216/421 | 12-214/129 | | CAC | 0.070 | 0.012 | 5.96 | 6.46 | 15.97 | (6.3e-05) **** | 1.9 | 11.3 | [0/100] |
| haplotype 13 | PT3 | 248 vs 85 | 10-347/165 | 10-347/203 | 10-349/224 | | CCT | 0.427 | 0.255 | 23.11 | 2.18 | 15.86 | (6.7e-05) **** | 2.7 | 18.8 | [1/100] |
| haplotype 14 | PT3 | 271 vs 168 | 12-197/244 | 10-349/97 | 12-214/129 | | CAC | 0.069 | 0.012 | 5.83 | 6.37 | 15.34 | (8.7e-05) **** | 1.8 | 10.4 | [0/100] |
| haplotype 15 | PT3 | 261 vs 86 | 12-206/366 | 10-347/220 | 10-349/224 | | CAT | 0.423 | 0.256 | 22.45 | 2.13 | 15.27 | (9.2e-05) **** | 2.4 | 7.8 | [0/100] |
| haplotype 16 | PT3 | 276 vs 176 | 12-226/167 | 10-347/220 | 12-223/207 | | CTT | 0.137 | 0.055 | 8.64 | 2.72 | 15.27 | (9.2e-05) **** | 1.4 | 7.1 | [0/100] |
| haplotype 17 | PT3 | 280 vs 178 | 10-347/203 | 12-216/421 | 12-219/230 | | AAG | 0.112 | 0.039 | 7.59 | 3.12 | 15.15 | (9.7e-05) **** | 2.2 | 21.1 | [2/100] |
| haplotype 18 | PT3 | 268 vs 170 | 12-197/244 | 10-347/220 | 12-214/129 | | CGC | 0.067 | 0.012 | 5.60 | 6.10 | 14.68 | (1.3e-04) **** | 2.0 | 12.7 | [0/100] |
| haplotype 19 | PT3 | 249 vs 88 | 12-206/366 | 10-347/165 | 10-347/220 | | CCA | 0.428 | 0.265 | 22.14 | 2.07 | 14.54 | (1.3e-04) **** | 2.8 | 9.4 | [0/100] |
| haplotype 20 | PT3 | 264 vs 86 | 12-206/366 | 10-346/141 | 10-349/224 | | CGT | 0.426 | 0.265 | 21.94 | 2.06 | 14.23 | (1.6e-04) **** | 2.6 | 11.2 | [0/100] |

TABLE 18B-continued

| haplotype 21 PT3 | 261 vs 85 | 12-206/366 | 10-347/203 | 10-349/224 | | CGT | 0.418 | 0.259 | 21.40 | 2.05 | 13.71 | (2.0e-04) | **** | 2.2 | 8.3 | [0/100] |
|---|---|---|---|---|---|---|---|---|---|---|---|---|---|---|---|---|
| haplotype 22 PT3 | 264 vs 84 | 12-206/366 | 10-349/97 | 10-349/224 | | CGT | 0.411 | 0.253 | 21.19 | 2.06 | 13.68 | (2.1e-04) | **** | 2.4 | 7.2 | [0/100] |
| haplotype 23 PT3 | 248 vs 87 | 12-206/366 | 10-347/165 | 10-347/203 | | CCG | 0.425 | 0.268 | 21.54 | 2.03 | 13.55 | (2.3e-04) | **** | 2.2 | 8.5 | [0/100] |
| haplotype 24 PT3 | 261 vs 86 | 12-206/366 | 10-347/111 | 10-349/224 | | CGT | 0.421 | 0.265 | 21.30 | 2.02 | 13.43 | (2.4e-04) | **** | 2.1 | 6.1 | [0/100] |
| haplotype 25 PT3 | 268 vs 164 | 12-197/244 | 10-347/111 | 12-214/129 | | CGC | 0.151 | 0.068 | 8.89 | 2.44 | 13.33 | (2.5e-04) | **** | 1.9 | 25.3 | [1/100] |
| haplotype 26 PT3 | 265 vs 89 | 12-206/366 | 10-346/141 | 10-347/220 | | CGA | 0.426 | 0.274 | 21.00 | 1.97 | 13.04 | (3.0e-04) | **** | 2.3 | 7.0 | [0/100] |
| haplotype 27 PT4 | 280 vs 173 | 10-349/97 | 12-196/119 | 12-216/421 | 12-219/230 | ATAG | 0.124 | 0.035 | 9.20 | 3.90 | 20.63 | (5.4e-06) | ****** | 1.5 | 11.6 | [0/100] |
| haplotype 28 PT4 | 274 vs 174 | 10-347/203 | 12-196/119 | 12-216/421 | 12-219/230 | ATAG | 0.117 | 0.031 | 8.89 | 4.14 | 20.59 | (5.7e-06) | ****** | 2.7 | 19.0 | [0/100] |
| haplotype 29 PT4 | 275 vs 171 | 10-349/97 | 12-196/119 | 12-214/129 | 12-219/230 | ATCG | 0.126 | 0.037 | 9.21 | 3.72 | 19.86 | (8.2e-06) | ****** | 2.0 | 11.8 | [0/100] |
| haplotype 30 PT4 | 276 vs 175 | 10-347/220 | 12-196/119 | 12-216/421 | 12-219/230 | GTAG | 0.121 | 0.035 | 8.92 | 3.80 | 19.84 | (8.2e-06) | ****** | 2.4 | 14.7 | [0/100] |
| haplotype 31 PT4 | 269 vs 172 | 10-347/203 | 12-196/119 | 12-214/129 | 12-219/230 | ATCG | 0.120 | 0.034 | 8.90 | 3.86 | 19.61 | (9.1e-06) | ****** | 2.4 | 12.2 | [0/100] |
| haplotype 32 PT4 | 280 vs 165 | 10-349/97 | 10-341/116 | 12-214/129 | 12-219/230 | AGCG | 0.127 | 0.038 | 9.30 | 3.73 | 19.55 | (9.5e-06) | ****** | 1.9 | 16.0 | [0/100] |
| haplotype 33 PT4 | 270 vs 172 | 10-347/220 | 12-196/119 | 12-214/129 | 12-219/230 | GTCG | 0.124 | 0.037 | 9.00 | 3.68 | 19.31 | (1.1e-05) | ****** | 2.8 | 19.3 | [0/100] |
| haplotype 34 PT4 | 282 VS 169 | 10-349/97 | 12-214/129 | 12-216/421 | 12-219/230 | ACAG | 0.124 | 0.038 | 9.00 | 3.62 | 18.98 | (1.3e-05) | ****** | 1.8 | 10.5 | [0/100] |
| haplotype 35 PT4 | 267 vs 167 | 12-197/244 | 12-208/35 | 12-214/129 | 12-223/207 | CTCC | 0.055 | 0.000 | 5.49 | 100.00 | 18.96 | (1.3e-05) | ****** | 2.6 | 21.7 | [2/100] |
| haplotype 36 PT4 | 285 vs 167 | 10-349/97 | 10-341/116 | 12-216/421 | 12-219/230 | AGAG | 0.127 | 0.039 | 9.12 | 3.55 | 18.89 | (1.4e-05) | ****** | 2.0 | 12.3 | [0/100] |
| haplotype 37 PT4 | 277 vs 172 | 10-347/220 | 12-214/129 | 12-216/421 | 12-219/230 | GCAG | 0.120 | 0.036 | 8.71 | 3.62 | 18.59 | (1.6e-05) | ****** | 2.3 | 25.8 | [1/100] |
| haplotype 38 PT4 | 275 vs 171 | 10-347/203 | 12-214/129 | 12-216/421 | 12-219/230 | ACAG | 0.116 | 0.033 | 8.52 | 3.80 | 18.57 | (1.6e-05) | ****** | 2.7 | 21.6 | [1/100] |
| haplotype 39 PT4 | 276 vs 162 | 10-347/220 | 12-214/129 | 12-214/129 | 12-219/230 | AGCG | 0.054 | 0.000 | 5.40 | 0.00 | 18.10 | (2.0e-05) | ****** | 2.7 | 18.6 | [1/100] |
| haplotype 40 PT4 | 245 vs 85 | 12-206/366 | 10-347/165 | 10-347/220 | 10-349/224 | CCAT | 0.429 | 0.246 | 24.18 | 2.30 | 17.77 | (2.5e-05) | ****** | 3.0 | 7.5 | [0/100] |
| haplotype 41 PT4 | 268 vs 81 | 12-208/35 | 12-206/366 | 10-349/97 | 12-216/421 | TCGG | 0.196 | 0.056 | 14.80 | 4.09 | 17.76 | (2.5e-05) | ****** | 1.8 | 15.1 | [0/100] |

TABLE 19

HAPLOTYPE FREQUENCY ANALYSIS
(Zyflo secondary effects)
89 ALT+ vs 208 ALT−

| MARKERS 12-lipoxygenase | 12-208-35 | 12-226-167 | 12-206-366 | 10-347-203 | 10-347-220 | 10-349-97 | 10-349-224 |
|---|---|---|---|---|---|---|---|
| | 5' gene | | intron 2 | exon 6 | | exon 8 | |
| Size (cases/controls) | 87/197 | 89/119 | 86/186 | 88/197 | 86/188 | 86/196 | 86/185 |
| frequency % (case/controls) | 58/59 (T) | 61/63 (C) | 55/58 (T) | 56/58 (A) | 56/59 (G) | 58/59 (A) | 54/59 (G) |
| diff freq. all. (cases − controls) | −0.8 | −2.1 | −3.7 | −2.2 | −3.0 | −1.4 | −4.8 |
| p value | 7.52e−01 * | 5.84e−01 * | 4.03e−01 * | 5.84e−01 * | 4.80e−01 * | 7.52e−01 * | 2.73e−01 * |

| # | | 12-208-35 | 12-226-167 | 12-206-366 | 10-347-203 | 10-347-220 | 10-349-97 | 10-349-224 |
|---|---|---|---|---|---|---|---|---|
| 1 | 87 vs 197 | A | G | | | | | |
| 2 | 83 vs 184 | | | | | A | | |
| 3 | 85 vs 185 | | | | | | | T |
| 4 | 85 vs 186 | | | C | | | | |
| 5 | 85 vs 179 | | | | | | | T |
| 6 | 85 vs 180 | | | C | | | | |
| 7 | 86 vs 188 | | | | | A | | |
| 8 | 82 vs 174 | | | C | | | | T |
| 9 | 85 vs 179 | | | | | | | T |
| 10 | 83 vs 177 | | | | | A | | T |
| 11 | 82 vs 183 | | | | | | G | T |
| 12 | 85 vs 183 | | | | G | | | T |
| 13 | 82 vs 168 | | | C | | | | T |
| 14 | 84 vs 175 | | | C | | A | | |
| 15 | 84 vs 184 | | | C | G | | | |
| 16 | 85 vs 180 | | | C | | | | |
| 17 | 82 vs 181 | | | | | | | T |
| 18 | 83 vs 187 | A | | | | | | |
| 19 | 83 vs 171 | | | | | A | | T |
| 20 | 83 vs 174 | | | C | | | | T |
| 21 | 82 vs 178 | | | | | | G | T |
| 22 | 82 vs 168 | | | C | | | | T |
| 23 | 82 vs 172 | | | C | G | | | T |
| 24 | 81 vs 166 | | | C | | A | | T |
| 25 | 80 vs 171 | | | C | | | | T |

| MARKERS 12-lipoxygenase | 12-196-119 | 12-214-129 | 12-216-421 | 12-219230 | 12-223-207 | | | | |
|---|---|---|---|---|---|---|---|---|---|
| Size (cases/controls) | 86/195 | 89/193 | 89/199 | 89/199 | 88/199 | | | | |
| frequency % (case/controls) | 72/69 (T) | 59/61 (T) | 58/63 (G) | 67/62 (A) | 62/63 (T) | | | | |
| diff freq. all. (cases − controls) | 3.4 | −2.4 | −4.7 | 4.5 | −0.6 | ESTIMATED FREQUENCIES | | | |
| p value | 4.03e−01 * | 5.84e−01 * | 2.73e−01 * | 2.94e−01 | 7.52e−01 * | haplotype frequencies | Odds | | P value |
| | | | | | | cases controls | ratio | Chi-S | (1 df) |

| # | | 12-196-119 | 12-214-129 | 12-216-421 | 12-219230 | 12-223-207 | cases | controls | ratio | Chi-S | (1 df) |
|---|---|---|---|---|---|---|---|---|---|---|---|
| 1 | 87 vs 197 | | | | | | 0.123 | 0.070 | 1.87 | 4.34 | (3.6e−02) |
| 2 | 83 vs 184 | C | | | | | 0.209 | 0.140 | 1.63 | 4.09 | (4.3e−02) |
| 3 | 85 vs 185 | | | A | | T | 0.151 | 0.048 | 3.53 | 16.76 | (4.2e−05) |
| 4 | 85 vs 186 | | | A | | T | 0.148 | 0.059 | 2.77 | 11.62 | (6.3e−04) |
| 5 | 85 vs 179 | | C | | | T | 0.151 | 0.066 | 2.52 | 9.85 | (1.7e−03) |
| 6 | 85 vs 180 | | C | | | T | 0.149 | 0.070 | 2.34 | 8.42 | (3.6e−03) |
| 7 | 86 vs 188 | | | A | | T | 0.157 | 0.076 | 2.25 | 8.36 | (3.8e−03) |
| 8 | 82 vs 174 | | | A | | T | 0.158 | 0.040 | 4.56 | 21.85 | (2.9e−06) |
| 9 | 85 vs 179 | | C | A | | T | 0.157 | 0.052 | 3.37 | 16.03 | (6.0e−05) |
| 10 | 83 vs 177 | | | A | | T | 0.162 | 0.057 | 3.22 | 15.30 | (9.2e−05) |
| 11 | 82 vs 183 | | | A | | T | 0.147 | 0.050 | 3.23 | 14.18 | (1.6e−04) |
| 12 | 85 vs 183 | | | A | | T | 0.143 | 0.049 | 3.21 | 13.97 | (1.8e−04) |
| 13 | 82 vs 168 | | C | | | T | 0.156 | 0.058 | 3.02 | 13.08 | (3.0e−04) |
| 14 | 84 vs 175 | | | A | | T | 0.155 | 0.062 | 2.78 | 11.77 | (5.9e−04) |
| 15 | 84 vs 184 | | | A | | T | 0.147 | 0.059 | 2.74 | 11.22 | (7.8e−04) |
| 16 | 85 vs 180 | | C | A | | T | 0.145 | 0.058 | 2.74 | 11.05 | (8.6e−04) |
| 17 | 82 vs 181 | T | | A | | T | 0.132 | 0.050 | 2.85 | 10.62 | (1.1e−03) |
| 18 | 83 vs 187 | T | T | | | T | 0.148 | 0.066 | 2.48 | 9.50 | (2.1e−03) |

TABLE 19-continued

HAPLOTYPE FREQUENCY ANALYSIS
(Zyflo secondary effects)
89 ALT+ vs 208 ALT−

| | | | | | | | | | | | |
|---|---|---|---|---|---|---|---|---|---|---|---|
| 19 | 83 vs 171 | | C | | | | T | 0.162 | 0.074 | 2.41 | 9.29 | (2.3e−03) |
| 20 | 83 vs 174 | | | A | A | | T | 0.111 | 0.041 | 2.92 | 9.24 | (2.3e−03) |
| 21 | 82 vs 178 | | C | | | | T | 0.152 | 0.068 | 2.45 | 9.22 | (2.3e−03) |
| 22 | 82 vs 168 | | C | A | | | T | 0.161 | 0.043 | 4.27 | 20.43 | (6.0e−06) |
| 23 | 82 vs 172 | | | A | | | T | 0.146 | 0.040 | 4.07 | 18.03 | (2.1e−05) |
| 24 | 81 vs 166 | | | A | | | T | 0.160 | 0.047 | 3.82 | 17.77 | (2.5e−05) |
| 25 | 80 vs 171 | T | | A | | | T | 0.137 | 0.037 | 4.17 | 17.18 | (3.4e−05) |

TABLE 20A

ALLELE FREQUENCY ANALYSIS
(Zyflo secondary effects)
CASES (85 ALT+) vs CONTROLS (208 ALT−)

| MARKERS PROTEIN 12-LO | 12-197/244 | 12-208/35 5'gene | 12-226/167 | 12-206/366 in2 | 10-346/141 ex5 |
|---|---|---|---|---|---|
| cases / controls | 81/196 | 87/197 | 89/199 | 86/186 | 88/197 |
| frequency % (case/controls) | 70/65(T) | 58/59(T) | 61/63(C) | 55/58(T) | 100/99(G) |
| diff freq. all. (cases − controls) | 5.8 | −0.8 | −2.1 | −3.7 | 0.5 |
| p value | 1.80e−01 * | 7.52e−01 * | 5.84e−01 * | 4.03e−01 * | HOM |
| Test Hardy Weinberg cases vs controls | −0.001 (HWE) 0.048 (HWD) | 0.008 (HWE) −0.007 (HWE) | −0.020 (HWE) 0.007 (HWE) | −0.031 (HWE) −0.007 (HWE) | 0.000 (HWD) 0.000 (HWD) |

| MARKERS PROTEIN 12-LO | 10-347/111 | 10-347/165 ex6 | 10-347/203 | 10-347/220 | 10-349/97 | 10-349/224 ex8 |
|---|---|---|---|---|---|---|
| cases / controls | 88/196 | 69/199 | 83/197 | 87/196 | 89/198 | 83/194 |
| frequency % (case/controls) | 99/100(G) | 100/99(C) | 56/58(A) | 43/57(G) | 59/59(A) | 54/57(G) |
| diff freq. all. (cases − controls) | −0.6 | 0.3 | −1.8 | 0.1 | −0.1 | −3.0 |
| p value | HOM | 7.43e−01# | 6.55e−01 * | 7.52e−01 * | 7.52e−01 * | 4.80e−01 * |
| Test Hardy Weinberg cases vs controls | 0.000 (HWD) 0.000 (HWD) | 0.000 (HWD) 0.000 (HWD) | −0.037 (HWE) 0.000 (HWE) | −0.020 (HWE) 0.002 (HWE) | 0.000 (HWE) 0.000 (HWE) | −0.029 (HWE) −0.003 (HWE) |

| MARKERS PROTEIN 12-LO | 10-341/116 ex14 | 12-196/119 | 12-214/129 | 12-216/421 markers in bac | 12-219/230 | 12-223/207 |
|---|---|---|---|---|---|---|
| cases / controls | 89/197 | 86/195 | 89/193 | 89/199 | 89/199 | 88/199 |
| frequency % (case/controls) | 90/89(G) | 72/69(T) | 59/61(T) | 58/63(G) | 67/62(G) | 62/63(T) |
| diff freq. all. (cases − controls) | 1.6 | 3.4 | −2.4 | −4.7 | 4.5 | −0.6 |
| p value | 5.27e−01 * | 4.03e−01 * | 5.84e−01 * | 2.73e−01 * | 2.94e−01 * | 7.52e−01 * |
| Test Hardy Weinberg cases vs controls | 0.002 (HWE) 0.764 (HWD) | 0.015 (HWE) 0.010 (HWE) | −0.011 (HWE) −0.014 (HWE) | −0.031 (HWE) −0.004 (HWE) | 0.002 (HWE) −0.016 (HWE) | 0.037 (HWE) 0.001 (HWE) |

TABLE 20B

HAPLOTYPE FREQUENCY ANALYSIS
(Zyflo secondary effects)
CASES (85 ALT+) vs CONTROLS (208 ALT−)

| | | | | MARKER 1 | MARKER 2 | MARKER 3 | MARKER 4 | MARKER 5 | HAPLOTYPE | Haplotype frequencies cases | controls | p-excess | Odds ratio | Chi-S | P value (1 df) | Av. Chi-S | Max Chi-s | No. of Iter >Iter/ |
|---|---|---|---|---|---|---|---|---|---|---|---|---|---|---|---|---|---|---|
| haplotype 1 | PT2 | 79 vs 192 | 12-197/244 | 12-196/119 | | | | | TT | 0.542 | 0.436 | 18.89 | 1.53 | 5.11 | (2.3e-02) ** | 1.7 | 6.7 | [3/100] |
| haplotype 2 | PT2 | 87 vs 197 | 12-208/35 | 12-226/167 | | | | | AG | 0.123 | 0.070 | 5.73 | 1.87 | 4.34 | (3.6e-02) * | 1.1 | 7.3 | [4/100] |
| haplotype 3 | PT2 | 84 vs 183 | 12-206/366 | 12-196/119 | | | | | CC | 0.205 | 0.139 | 7.68 | 1.60 | 3.75 | (5.1e-02) * | 1.3 | 8.0 | [11/100] |
| haplotype 4 | PT2 | 84 vs 192 | 10-347/220 | 12-196/119 | | | | | GT | 0.486 | 0.400 | 14.25 | 1.41 | 3.49 | (6.1e-02) * | 1.0 | 5.3 | [8/100] |
| haplotype 5 | PT2 | 81 vs 193 | 10-347/203 | 12-196/119 | | | | | GC | 0.207 | 0.144 | 7.46 | 1.56 | 3.43 | (6.1e-02) * | 1.3 | 10.3 | [9/100] |
| haplotype 6 | PT3 | 82 vs 194 | 10-349/224 | 12-216/421 | 12-223/207 | | | | TAT | 0.158 | 0.064 | 10.09 | 2.76 | 12.35 | (4.3e-04) *** | 2.1 | 11.0 | [0/100] |
| haplotype 7 | PT3 | 85 vs 186 | 12-206/366 | 12-216/421 | 12-223/207 | | | | CAT | 0.148 | 0.059 | 9.44 | 2.77 | 11.62 | (6.3e-04) *** | 2.8 | 24.7 | [3/100] |
| haplotype 8 | PT3 | 77 vs 180 | 12-197/244 | 12-206/366 | 12-196/119 | | | | TTT | 0.434 | 0.286 | 20.67 | 1.91 | 10.62 | (1.1e-03) *** | 1.8 | 10.9 | [1/100] |
| haplotype 9 | PT3 | 78 vs 190 | 12-197/244 | 10-347/220 | 12-196/119 | | | | TGT | 0.433 | 0.291 | 19.96 | 1.86 | 9.98 | (1.6e-03) *** | 1.7 | 9.3 | [0/100] |
| haplotype 10 | PT3 | 76 vs 187 | 12-197/244 | 10-349/224 | 12-216/421 | | | | TGT | 0.435 | 0.293 | 20.17 | 1.86 | 9.88 | (1.7e-03) *** | 1.8 | 6.9 | [0/100] |
| haplotype 11 | PT3 | 77 vs 191 | 12-197/244 | 10-349/224 | 12-216/421 | | | | CTA | 0.137 | 0.056 | 8.56 | 2.66 | 9.76 | (1.7e-03) *** | 1.6 | 11.3 | [1/100] |
| haplotype 12 | PT3 | 75 vs 191 | 12-197/244 | 10-347/203 | 12-196/119 | | | | TAT | 0.431 | 0.294 | 19.42 | 1.82 | 9.13 | (2.4e-03) *** | 1.3 | 6.1 | [0/100] |
| haplotype 13 | PT4 | 81 vs 183 | 12-206/366 | 10-349/224 | 12-216/421 | 12-223/207 | | | CTAT | 0.160 | 0.058 | 10.82 | 3.10 | 14.38 | (1.5e-04) **** | 2.0 | 13.9 | [0/100] |
| haplotype 14 | PT4 | 84 vs 185 | 12-206/366 | 10-346/141 | 12-216/421 | 12-223/207 | | | CGAT | 0.158 | 0.058 | 10.62 | 3.04 | 14.20 | (1.6e-04) **** | 3.3 | 23.7 | [2/100] |
| haplotype 15 | PT4 | 82 vs 188 | 10-349/224 | 12-214/129 | 12-216/421 | 12-223/207 | | | TCAT | 0.161 | 0.063 | 10.50 | 2.86 | 13.12 | (2.8e-04) **** | 2.9 | 25.2 | [3/100] |
| haplotype 16 | PT4 | 81 vs 184 | 12-206/366 | 10-347/203 | 12-216/421 | 12-223/207 | | | CGAT | 0.153 | 0.059 | 10.03 | 2.89 | 12.50 | (3.9e-04) *** | 2.7 | 13.0 | [1/100] |
| haplotype 17 | PT4 | 82 vs 191 | 10-347/111 | 10-349/224 | 12-216/421 | 12-223/207 | | | GTAT | 0.159 | 0.064 | 10.14 | 2.77 | 12.33 | (4.3e-04) *** | 2.3 | 15.7 | [2/100] |
| haplotype 18 | PT4 | 82 vs 192 | 10-346/141 | 10-349/224 | 12-216/421 | 12-223/207 | | | GTAT | 0.158 | 0.065 | 9.96 | 2.70 | 11.85 | (5.6e-04) *** | 2.6 | 18.1 | [3/100] |
| haplotype 19 | PT4 | 81 vs 192 | 10-349/224 | 10-349/224 | 12-216/421 | 12-223/207 | | | ATAT | 0.159 | 0.066 | 10.02 | 2.69 | 11.78 | (5.9e-04) *** | 2.2 | 9.9 | [0/100] |
| haplotype 20 | PT4 | 84 vs 183 | 12-206/366 | 10-347/220 | 12-216/421 | 12-223/207 | | | CAAT | 0.150 | 0.059 | 9.60 | 2.79 | 11.72 | (5.9e-04) *** | 2.3 | 17.1 | [3/100] |
| haplotype 21 | PT4 | 85 vs 183 | 12-206/366 | 10-347/111 | 12-216/421 | 12-223/207 | | | CGAT | 0.148 | 0.059 | 9.42 | 2.76 | 11.45 | (7.0e-04) *** | 2.0 | 12.3 | [1/100] |
| haplotype 22 | PT4 | 76 vs 185 | 12-197/244 | 10-346/141 | 10-349/224 | 12-196/119 | | | TGGT | 0.435 | 0.284 | 21.12 | 1.94 | 11.16 | (8.2e-04) *** | 2.0 | 8.7 | [0/100] |
| haplotype 23 | PT4 | 85 vs 180 | 12-206/366 | 10-349/224 | 12-223/207 | 12-196/119 | | | CCAT | 0.145 | 0.058 | 9.20 | 2.74 | 11.03 | (8.6e-04) *** | 2.3 | 15.7 | [3/100] |
| haplotype 24 | PT4 | 80 vs 192 | 10-347/203 | 10-349/224 | 12-216/421 | 12-223/207 | | | GTAT | 0.156 | 0.065 | 9.65 | 2.63 | 11.00 | (8.6e-04) *** | 1.7 | 14.4 | [3/100] |
| haplotype 25 | PT4 | 82 vs 190 | 10-347/203 | 10-341/116 | 12-214/129 | 12-223/207 | | | GGCT | 0.125 | 0.046 | 8.22 | 2.94 | 10.86 | (9.6e-04) *** | 1.8 | 18.8 | [2/100] |
| haplotype 26 | PT5 | 77 vs 190 | 12-197/244 | 12-208/35 | 12-196/119 | 12-216/421 | 12-219/230 | TATGA | 0.138 | 0.050 | 9.27 | 3.06 | 12.24 | (4.5e-04) *** | 2.6 | 13.2 | [2/100] |
| haplotype 27 | PT5 | 77 vs 189 | 12-197/244 | 12-208/35 | 10-349/97 | 12-196/119 | 12-223/207 | TTAIC | 0.127 | 0.045 | 8.56 | 3.08 | 11.42 | (7.0e-04) *** | 1.6 | 10.3 | [0/100] |
| haplotype 28 | PT5 | 77 vs 184 | 12-197/244 | 12-208/35 | 12-196/119 | 12-214/129 | 12-219/230 | TATTA | 0.126 | 0.047 | 8.30 | 2.93 | 10.42 | (1.2e-03) *** | 2.4 | 14.6 | [4/100] |
| haplotype 29 | PT5 | 76 vs 188 | 12-197/244 | 12-208/35 | 10-347/220 | 12-196/119 | 12-223/207 | TTGTC | 0.121 | 0.048 | 7.63 | 2.71 | 8.84 | (2.9e-03) *** | 1.4 | 9.5 | [1/100] |
| haplotype 30 | PT5 | 76 vs 176 | 12-197/244 | 12-208/35 | 12-206/366 | 10-341/116 | 12-196/119 | TTTGT | 0.195 | 0.099 | 10.67 | 2.21 | 8.82 | (2.9e-03) *** | 1.3 | 7.3 | [0/100] |

TABLE 21

Summary of Association Study Results and Permutation Tests

| 12-Lipoxygenase | 12-206-366 intron 2 | 10-347-203 exon 6 | 10-349-224 exon 8 | 12-196-119 | 12-216-421 | 12-219-230 | 12-223-207 | MARKERS | |
|---|---|---|---|---|---|---|---|---|---|
| | C | | T | | A | | T | HAPLOTYPE 8 Zyflo secondary effects (ALT+ vs ALT−) | |
| | | A | | T | A | G | | HAPLOTYPE 14 Asthma (ALT vs US) | |
| | 4.03E−01 | 5.84E−01 | 7.52E−01 | 4.03E−01 | 2.73E−01 | 2.94E−01 | 7.52E−01 | p value | ALT+ vs |
| | −3.7 | −2.2 | −1.4 | 3.4 | −4.7 | 4.5 | −0.6 | diff all. Freq | ALT− |
| | 2.73E−01 | 6.55E−01 | 5.27E−01 | 6.55E−01 | 3.71E−01 | 1.80E−01 | 7.52E−01 | p value | ALT vs |
| | −4.6 | −1.2 | −1.9 | −1.2 | −2.9 | −4.2 | 0.8 | diff all. Freq | caucasian US |

| HAPLOTYPE 8 (ALT+ vs ALT−) Zyflo | sample sizes cases vs | haplotype frequencies | | | | | PERMUTATIONS TEST RESULTS | | |
|---|---|---|---|---|---|---|---|---|---|
| secondary effects | controls | cases | controls | odds-ratio | chi-S | P value | Av. Chi-S | Max Chi-S | >Iter/nb of Iter. |
| ALT+ vs ALT− | 82 vs 174 | 0.158 | 0.04 | 4.56 | 21.85 | 2.90E−06 | 3.1 | 29.9 | 5/1 000 |
| | | | | | | | 3.3 | 40.9 | 77/10 000 |
| ALT vs caucasian US | 256 vs 83 | 0.059 | 0 | | 10.12 | 1.40E−03 | 3.5 | 37.6 | 82/1 000 |

| HAPLOTYPE 14 (ALT vs US) Asthma | sample sizes cases vs controls | haplotype frequencies | | | | | PERMUTATIONS TEST RESULTS | | |
|---|---|---|---|---|---|---|---|---|---|
| | | cases | controls | odds-ratio | chi-S | P value | Av. Chi-S | Max Chi-S | >Iter/nb of Iter. |
| ALT+ vs ALT− | 85 vs 193 | 0.097 | 0.109 | −1.34 | 0.18 | 6.50E−01 | 2.1 | 24.1 | 785/1 000 |
| ALT vs caucasian US | 278 vs 174 | 0.118 | 0.031 | 4.18 | 21.01 | 4.40E−06 | 2.8 | 38.6 | 39/10 000 |
| | | | | | | | 2.8 | 29.9 | 7/1 000 |

TABLE 22

Permutations Test Results

| 12-Lipoxygenase | 12-206/ 366 in2 | 10-349/ 97 ex8 | 10-349/ 224 ex8 | 12-196/ 119 | 12-214/ 129 | 12-216/ 421 | 12-219/ 230 | 12-223/ 207 | MARKERS | |
|---|---|---|---|---|---|---|---|---|---|---|
| | C | | T | in bac (not localization in Bac: 3' or 5' gene) | | A | | T | HAPLOTYPE 1 | (ALT+ vs ALT−) |
| | | A | | | C | | G | | HAPLOTYPE 2 | (ALT vs US) |
| | | A | | T | A | G | | | HAPLOTYPE 3 | |
| | 4.03e−01 | 7.52e−01 | 4.80e−01 | 4.03e−01 | 5.84e−01 | 2.73e−01 | 2.94e−01 | 7.52e−01 | p value | ALT+ vs |
| | −3.7 | −0.1 | −3.0 | 3.4 | −2.4 | −4.7 | 4.5 | −0.6 | (cases vs | ALT− |
| | (54 vs 58) | (58 vs 59) | (54 vs 57) | (72 vs 68) | (58 vs 61) | (57 vs 62) | (66 vs 62) | (61 vs 62) | controls) | |
| | 2.73e−01 | 6.55e−01 | 2.06e−01 | 6.55e−01 | 7.52e−01 | 3.71e−01 | 1.80e−01 | 7.52e−01 | p value | ALT vs |
| | −4.6 | −1.4 | −4.1 | −1.2 | −0.7 | −2.9 | −4.2 | 0.8 | (cases vs | caucasian US |
| | (57 vs 61) | (59 vs 60) | (56 vs 60) | (69 vs 70) | (60 vs 61) | (61 vs 64) | (63 vs 67) | (62 vs 61) | controls) | |

Zyflo secondary effects

| HAPLOTYPE 1 (ALT+ vs ALT−) | sample sizes cases vs controls | haplotype frequencies | | p- excess | odds- ratio | chi-S | P value | | PERMUTATIONS TEST RESULTS | | |
|---|---|---|---|---|---|---|---|---|---|---|---|
| (Zyflo secondary effects) CTAT | | cases | controls | | | | | | Av Chi-S | Max Chi-S | >Iter/nb of Iter. |
| ALT+ vs ALT− | 81 vs 183 | 0.16 | 0.058 | 10.82 | 3.10 | 14.38 | 1.50E−04 | **** | 2 | 13.9 | 0/100 |
| | | | | | | | | | 2.7 | 33.6 | 18/1000 |
| ALT+ vs ALT− (1) | 81 vs 99 | 0.16 | 0.065 | 10.11 | 2.72 | 8.28 | 4.00E−03 | *** | 3.3 | 23.1 | 118/1000 |
| ALT+ vs ALT− (2) | 81 vs 84 | 0.16 | 0.044 | 12.12 | 4.15 | 12.23 | 4.50E−04 | *** | 2.7 | 19.6 | 20/1000 |
| ALT vs caucasian US | 264 vs 83 | 0.071 | 0 | 302,77# | 7.08 | 12.37 | 4.30E−04 | ***TH | 2.6 | 23 | 25/1000 |

Asthma gene

| HAPLOTYPE 2 (ALT vs US) | sample sizes cases vs controls | haplotype frequencies | | p- excess | odds- ratio | chi-S | P value | | PERMUTATIONS TEST RESULTS | | |
|---|---|---|---|---|---|---|---|---|---|---|---|
| (Asthma gene) ACG | | cases | controls | | | | | | Av. Chi-S | Max Chi-S | >Iter/nb of Iter. |
| ALT+ vs ALT− | 89 vs 193 | 0.131 | 0.121 | 1.14 | 1.10 | 0.11 | 6.50E−01 | * | 1.3 | 18.1 | 760/1000 |
| ALT+ vs ALT− (1) | 89 vs 104 | 0.131 | 0.115 | 1.84 | 1.16 | 0.20 | 5.80E−01 | * | 1.5 | 14.6 | 683/1000 |
| ALT+ vs ALT− (2) | 89 vs 89 | 0.131 | 0.134 | −0.26 | 0.98 | 0.00 | 7.50E−01 | * | 1.4 | 16.2 | 946/1000 |
| ALT vs caucasian US | 282 vs 174 | 0.125 | 0.041 | 8.73 | 3.32 | 17.87 | 2.30E−05 | ***** | 1.8 | 8.5 | 0/100 |

TABLE 22-continued

Permutations Test Results

|  |  |  |  |  |  |  | 2 | 19.9 | 2/1000 |
|---|---|---|---|---|---|---|---|---|---|
| HAPLOTYPE 3 (ALT vs US) | sample sizes cases vs | haplotype frequencies | | p-excess | odds-ratio | chi-S | P value | PERMUTATIONS TEST RESULTS | | |
| (Asthma gene) ATAG | controls | cases | controls | | | | | Av. Chi-S | Max Chi-S | >Iter/nb of Iter. |
| ALT+ vs ALT− | 86 vs 194 | 0.123 | 0.144 | 1.04 | 1.09 | 0.10 | 7.50E−01 * | 1.5 | 15.5 | 816/1000 |
| ALT+ vs ALT− (1) | 86 vs 100 | 0.123 | 0.108 | 1.69 | 1.16 | 0.21 | 5.80E−01 * | 1.6 | 16.6 | 735/1000 |
| ALT+ vs ALT− (2) | 86 vs 94 | 0.123 | 0.11 | 1.54 | 1.14 | 0.16 | 6.50E−01 * | 1.5 | 19.3 | 750/1000 |
| ALT vs caucasian US | 280 vs 173 | 0.124 | 0.035 | 9.2 | 3.9 | 20.63 | 5.40E−06 ****** | 1.5 | 11.6 | 0/100 |
|  |  |  |  |  |  |  |  | 2 | 18.7 | 0/1000 |

TABLE 23

Allele Frequency

| | | | ALT+ | | | | ALT− | | | | US Caucasian | | | |
|---|---|---|---|---|---|---|---|---|---|---|---|---|---|---|---|
| PROTEINS | Marker | size | A | C | G | T | size | A | C | G | T | size | A | C | G | T |
| 12-LO | 12-197/244 | 81 | | 29.63 | | 70.37 | 196 | | 35.46 | | 64.54 | 180 | | 32.78 | | 67.22 |
| 2 | 12-208/35 | 87 | 41.95 | | | 58.05 | 197 | 41.12 | | | 58.88 | 182 | 42.31 | | | 57.69 |
| 3 | 12-226/167 | 89 | | 60.67 | 39.33 | | 199 | | 62.81 | 37.19 | | 188 | | 58.78 | 41.22 | |
| 4 | 12-206/366 | 86 | | 45.35 | | 54.65 | 186 | | 41.67 | | 58.33 | 89 | | 38.20 | | 61.80 |
| 5 | 10-346/141 | 88 | | | HOM | | 197 | 0.51 | | 99.49 | | 185 | | | HOM | |
| 6 | 10-347/111 | 88 | | 0.57 | 99.43 | | 196 | | | HOM | | 180 | | | HOM | |
| 7 | 10-347/165 | 69 | | HOM | | | 199 | | | 99.75 | 0.25 | 185 | | HOM | | |
| 8 | 10-347/203 | 83 | 56.02 | | 43.98 | | 197 | 57.87 | | 42.13 | | 184 | 58.42 | | 41.58 | |
| 9 | 10-347/220 | 87 | 42.53 | | 57.47 | | 196 | 42.60 | | 57.40 | | 184 | 40.49 | | 59.51 | |
| 10 | 10-349/97 | 89 | 58.99 | | 41.01 | | 198 | 59.09 | | 40.91 | | 182 | 60.44 | | 39.56 | |
| 11 | 10-349/224 | 83 | | | 54.22 | 45.78 | 194 | | | 57.22 | 42.78 | 177 | | | 60.45 | 39.55 |
| 12 | 10-341/116 | 89 | 9.55 | | 90.45 | | 197 | 11.17 | | 88.83 | | 176 | 10.80 | | 89.20 | |
| 13 | 12-196/119 | 86 | | 27.91 | | 72.09 | 195 | | 31.28 | | 68.72 | 184 | | 29.08 | | 70.92 |
| 14 | 12-214/129 | 89 | | 41.01 | | 58.99 | 193 | | 38.60 | | 61.40 | 181 | | 38.67 | | 61.33 |
| 15 | 12-216/421 | 89 | 42.13 | | 57.87 | | 199 | 37.44 | | 62.56 | | 182 | 35.99 | | 64.01 | |
| 16 | 12-219/230 | 89 | 66.85 | | 33.15 | | 199 | 62.31 | | 37.69 | | 187 | 67.91 | | 32.09 | |
| 17 | 12-223/207 | 88 | | 38.07 | | 61.93 | 199 | | 37.44 | | 62.56 | 186 | | 38.44 | | 61.56 |

SEQUENCE LISTING (1304 sequences)

SEQ ID NO: 1 - DNA, 955 bp, Homo Sapiens
  allele 478: 10-253-118 : polymorphic base A or G
  misc_binding 458..477: 10-253-118.mis1, potential
  misc_binding 479..498: 10-253-118.mis2, potential complement
  primer_bind 361..379: upstream amplification primer
  primer_bind 761..780: downstream amplification primer, complement
  misc_binding 466..490: 10-253-118 potential probe
  misc_feature 198: n=a, g, c or t
tctgggctgctctggactgcggccaggcggtcttctgcgggaatccgggcaggcagggcgggctgcgctcccctccccggctctcccggtgccccttgtctttttgttctgtctcagcagctctctattaagatgaatggcatttccaaaggcttcacctctgataagtgttcctctgcagctgcagccagaatcttnaatgtgcgcgctgtaatttaatggccgtctcggctattaacacgctcttctcgggtgaagtggactccctccatccccgggcctctgcacgtgctctgcgcactggctgggggtgactccaaggagctcagagcggggtgcccggcacctctcgccaggcgcctttcgaccttctaaagcgcgaatggctggacttttctcccatgtgtggggccccagaaggtgtggggccccagaaggtgtggggtccctgcgttccacggagcccggaaggtttccrgtgatggtgggggctgaccacgttggtccccgtgggtgctgttttcatgtgccggcagattgggatgagtttaaaagacagaagcgtgtaggatagagaaacttctttaaaaactggaaattttaatctggggattataactattggacagtcaagtgcaagagtgaatacacttctcactccctcctcccaatttttatttgcgggattagtcagtccccctctgccacatgataattgtgagaactaccagggtcttcattctcctgccatctggttgacctctccaagaatggacacccgggcagcctgggccaatgaggctgtcctaagagtttagatgagagaagtcagtctttgacaggtgatggaagctgtaaaatgtaaaactccacagttggtgaagatgtctccaggaaacaggtctgcagagagaatacgtttgacatgctaagagaagctgagagagagcgagag

SEQ ID NO: 2 - DNA, 955 bp, Homo Sapiens
  allele 478: 10-253-298 : polymorphic base G or C
  misc_binding 459..477: 10-253-298.mis1
  misc_binding 479..498: 10-253-298.mis2, potential complement
  primer_bind 181..199: upstream amplification primer
  primer_bind 581..600: downstream amplification primer, complement
  misc_binding 466..490: 10-253-298 potential probe
  misc_feature 18: n=a, g, c or t
gctgcagccagaatcttnaatgtgcgcgctgtaatttaatggccgtctcggctattaacacgctcttctcgggtgaagtggactccctccatccccgggcctctgcacgtgctctgcgcactggctgggggtgactccaaggagctcagagcggggtgcccggcacctctcgccaggcgcctttcgaccttctaaagcgcgaatggctggacttttctcccatgtgtggggccccagaaggtgtggggccccagaaggtgtggggtccctgcgttccacggagcccggaaggtttccagtgatggtgggggctgaccacgttggtccccgtgggtgctgttttcatgtgccggcagattgggatgagtttaaaagacagaagcgtgtaggatagagaaacttctttaaaaactggaaattttaatctggggattataactattggacagtcaagtgcaagagtgaatacacttctcastccctcctcccaatttttatttgcgggattagtcagtccccctctgccacatgataattgtgagaactaccagggtcttcattctcctgccatctggttgacctctccaagaatggacacccgggcagcctgggccaatgaggctgtcctaagagtttagatgagagaagtcagtctttgacaggtgatggaagctgtaaaatgtaaaactccacagttggtgaagatgtctccaggaaacaggtctgcagagagaatacgtttgacatgctaagagaagctgagagagagcgagaggagagattggaagaaagacagagacagaggtagagagaagggaaagagagagagaaagggacagaagagagagaaaatagagggggccgggcgcggtggctcacgcctgtaatctcagcactttgggaggccgaggcgggcagatcacgaggtcaggagatcgagaccatcccggctaac

SEQ ID NO: 3 - DNA, 955 bp, Homo Sapiens
  allele 478: 10-253-315 : polymorphic base C or T
  misc_binding 458..477: 10-253-315.mis1, potential
  misc_binding 479..498: 10-253-315.mis2, potential complement
  primer_bind 164..182: upstream amplification primer
  primer_bind 564..583: downstream amplification primer, complement
  misc_binding 466..490: 10-253-315 potential probe
  misc_feature 1: n=a, g, c or t
naatgtgcgcgctgtaatttaatggccgtctcggctattaacacgctcttctcgggtgaagtggactccctccatccccgggcctctgcacgtgctctgcgcactggctgggggtgactccaaggagctcagagcggggtgcccggcacctctcgccaggcgcctttcgaccttctaaagcgcgaatggctggacttttctcccatgtgtggggccccagaaggtgtggggccccagaaggtgtggggtccctgcgttccacggagcccggaaggtttccagtgatggtgggggctgaccacgttggtccccgtgggtgctgttttcatgtgccggcagattgggatgagtttaaaagacagaagcgtgtaggatagagaaacttctttaaaaactggaaattttaatctggggattataactattggacagtcaagtgcaagagtgaatacacttctcactccctcctcccaatttytatttgcgggattagtcagtccccctctgccacatgataattgtgagaactaccagggtcttcattctcctgccatctggttgacctctccaagaatggacacccgggcagcctgggccaatgaggctgtcctaagagtttagatgagagaagtcagtctttgacaggtgatggaagctgtaaaatgtaaaactccacagttggtgaagatgtctccaggaaacaggtctgcagagagaatacgtttgacatgctaagagaagctgagagagagcgagaggagagattggaagaaagacagagacagaggtagagagaagggaaagagagagagaaagggacagaagagagagaaaatagagggggccgggcgcggtggctcacgcctgtaatctcagcactttgggaggccgaggcgggcagatcacgaggtcaggagatcgagaccatcccggctaacacggtgaaacccccgtc

SEQ ID NO: 4 - DNA, 955 bp, Homo Sapiens
  allele 478: 10-499-155 : polymorphic base A or G
  misc_binding 458..477: 10-499-155.mis1, potential
  misc_binding 479..498: 10-499-155.mis2, potential complement
  primer_bind 324..343: upstream amplification primer
  primer_bind 536..553: downstream amplification primer, complement
  misc_binding 466..490: 10-499-155 potential probe
gtgatggtgggggctgaccacgttggtccccgtgggtgctgttttcatgtgccggcagattgggatgagtttaaaagacagaagcgtgtaggatagagaaacttctttaaaaactggaaattttaatctggggattataactattggacagtcaagtgcaagagtgaatacacttctcactccctcctcccaatttttatttgcgggattagtcagtccccctctgccacatgataattgtgagaactaccagggtcttcattctcctgccatctggttgacctctccaagaatggacacccgggcagcctgggccaatgaggctgtcctaagagtttagatgagagaagtcagtctttgacaggtgatggaagctgtaaaatgtaaaactccacagttggtgaagatgtctccaggaaacaggtctgcagagagaatacgtttgacatgctaagagaagctgagagagagcgagagragagattggaagaaagacagagacagaggtagagagaagggaaagagagagagaaagggacagaagagagagaaaatagagggggccgggcgcggtggctcacgcctgtaatctcagcactttgggaggccgaggcgggcagatcacgaggtcaggagatcgagaccatcccggctaacacggtgaaacccccgtctctactaaaaaatataaaaaaaattagccaggcgtggtggtgggtgcctgtagtcccagctactgaggaggctgagacaggagaatggcgtgaacccgggaggcagagcttgcagtgagctgagatcgcgccactgcactccagcctgggcaacagagcaagactccgtctcaaaaaaaaaaaaaaaaaagagaggaagggcgggagagagagagagagaaagctctctagctccaaggcctaaccacatctctgttcttttcaacttcagctgtcagatt

SEQ ID NO: 5 - DNA, 955 bp, Homo Sapiens
  allele 478: 10-520-256 : polymorphic base C or T
  misc_binding 458..477: 10-520-256.mis1, potential
  misc_binding 479..498: 10-520-256.mis2, potential complement
  primer_bind 294..310: upstream amplification primer
  primer_bind 743..760: downstream amplification primer, complement
  misc_binding 466..490: 10-520-256 potential probe
cttctcactccctcctcccaatttttatttgcgggattagtcagtccccctctgccacatgataattgtgagaactaccagggtcttcattctcctgccatctggttgacctctccaagaatggacacccgggcagcctgggccaatgaggctgtcctaagagtttagatgagagaagtcagtctttgacaggtgatggaagctgtaaaatgtaaaactccacagttggtgaagatgtctccaggaaacaggtctgcagagagaatacgtttgacatgctaagagaagctgagagagagcgagaggagagattggaagaaagacagagacagaggtagagagaagggaaagagagagagaaagggacagaagagagagaaaatagagggggccgggcgcggtggctcacgcctgtaatctcagcactttgggaggccgaggcgggcagatcacgaggtcaggagatcgagaccatccyggctaacacggtgaaacccccgtctctactaaaaaatataaaaaaaattagccaggcgtggtggtgggtgcctgtagtcccagctactgaggaggctgagacaggagaatggcgtgaacccgggaggcagagcttgcagtgagctgagatcgcgccactgcactccagcctgggcaacagagcaagactccgtctcaaaaaaaaaaaaaaaaaagagaggaagggcgggagagagagagagagaaagctctctagctccaaggcctaaccacatctctgttcttttcaacttcagctgtcagatttttagactctttgagtgaataaattctcctttttgcttaaactagtttgagctaagtttctattgcttgcaactggaatactttgtaagaggactggccttcatttctgatgcattgtcactaagatgtaagtgttagaagagctaacgctttatggggttcaaactccttg

SEQ ID NO: 6 - DNA, 955 bp, Homo Sapiens
  allele 478: 10-500-258 : polymorphic base G or T
  misc_binding 458..477: 10-500-258.mis1, potential
  misc_binding 479..498: 10-500-258.mis2, potential complement
  primer_bind 221..237: upstream amplification primer
  primer_bind 670..687: downstream amplification primer, complement
  misc_binding 466..490: 10-500-258 potential probe
actaccagggtcttcattctcctgccatctggttgacctctccaagaatggacacccgggcagcctgggccaatgaggctgtcctaagagtttagatgagagaagtcagtctttgacaggtgatggaagctgtaaaatgtaaaactccacagttggtgaagatgtctccaggaaacaggtctgcagagagaatacgtttgacatgctaagagaagctgagagagagcgagaggagagattggaagaaagacagagacagaggtagagagaagggaaagagagagagaaagggacagaagagagagaaaatagagggggccgggcgcggtggctcacgcctgtaatctcagcactttgggaggccgaggcgggcagatcacgaggtcaggagatcgagaccatcccggctaacacggtgaaacccccgtctctactaaaaaatataaaaaaaattagccaggcgtggtggtgggtgcckgtagtcccagctactgaggaggctgagacaggagaatggcgtgaacccgggaggcagagcttgcagtgagctgagatcgcgccactgcactccagcctgggcaacagagcaagactccgtctcaaaaaaaaaaaaaaaaaagagaggaagggcgggagagagagagagagaaagctctctagctccaaggcctaaccacatctctgttcttttcaacttcagctgtcagatttttagactctttgagtgaataaattctcctttttgcttaaactagtttgagctaagtttctattgcttgcaactggaatactttgtaagaggactggccttcatttctgatgcattgtcactaagatgtaagtgttagaagagctaacgctttatggggttcaaactccttggctaccaaaacctaaacatcccctgaaacttaccaaactgcaggtatgaattggatctcactaaggtgaatat

SEQ ID NO: 7 - DNA, 955 bp, Homo Sapiens
  allele 478: 10-500-410 : polymorphic base A or G
  misc_binding 458..477: 10-500-410.mis1, potential
  misc_binding 479..498: 10-500-410.mis2, potential complement
  primer_bind 70..86: upstream amplification primer
  primer_bind 519..536: downstream amplification primer, complement
  misc_binding 466..490: 10-500-410 potential probe
gttggtgaagatgtctccaggaaacaggtctgcagagagaatacgtttgacatgctaagagaagctgagagagagcgagaggagagattggaagaaagacagagacagaggtagagagaagggaaagagagagagaaagggacagaagagagagaaaatagagggggccgggcgcggtggctcacgcctgtaatctcagcactttgggaggccgaggcgggcagatcacgaggtcaggagatcgagaccatcccggctaacacggtgaaacccccgtctctactaaaaaatataaaaaaaattagccaggcgtggtggtgggtgcctgtagtcccagctactgaggaggctgagacaggagaatggcgtgaacccgggaggcagagcttgcagtgagctgagatcgcgccactgcactccagcctgggcaacagagcaagactccgtctcaaaaaaaaaaaaaaaaaagagaggaagrgcgggagagagagagagagaaagctctctagctccaaggcctaaccacatctctgttcttttcaacttcagctgtcagatttttagactctttgagtgaataaattctcctttttgcttaaactagtttgagctaagtttctattgcttgcaactggaatactttgtaagaggactggccttcatttctgatgcattgtcactaagatgtaagtgttagaagagctaacgctttatggggttcaaactccttggctaccaaaacctaaacatcccctgaaacttaccaaactgcaggtatgaattggatctcactaaggtgaatatacaaatcttgcaagtgctgagccctaaccaatcttgtaataactctgtggtagttaattttatgtcaaattgattgagctaaaaaatgcccaggtagctggtaaaatgtttttttctgggtgtgttagggagggtgtttctgaaagagatc

SEQ ID NO: 8 - DNA, 955 bp, Homo Sapiens
  allele 478: 10-503-159 : polymorphic base G or T
  misc_binding 458..477: 10-503-159.mis1, potential
  misc_binding 479..498: 10-503-159.mis2, potential complement
  primer_bind 326..343: upstream amplification primer
  primer_bind 760..780: downstream amplification primer, complement
  misc_binding 466..490: 10-503-159 potential probe
tgggtgtcatcaatccactgagggcctgaatagaacaaaaagcgggcagaagggcaaattccctcttcttcttgagctgggccatccatcttctcctgcccttggacactggagccccttgttctccagcttttggattcagactgggtcttgcaccattgccctccatcttctcctgcccttggacactggagccccttgttctccagcttttggattcagactgggtcttgcaccattgccctccttgatgctcaggcctttgaatgcagactggtctccaccagcagcttttctgagtctccagcttgcagatggcaaaccatgaaacttcatggtgtccatgagcatgtgaaccaatttctattataaatctgcaatatatatatatgaggagacttatttatatattggttcagtttctctggagagccttggctaatataaagtctatactctacaaagtgccctaggtackcagggagtacccaagtgtgtcatgaccagcccgacagccctggctgctggcttccccgcacacaactctgcacgctgccttcatcagcctttctctctcagctgaaccgagggcattgaagcgggcctctggcactgtacctatgagggagcaatatcttcccctacactgacctcttccgtgccgagatgcagccctccctgctgccactagttacagtggtccatgttccctttcaaagtgaagttttgataaaagcacctcttaaccaatgccaaatagctaagtctgggacaaagattgcaggtattttgcattttccatgtaacctcagagggattgccattcacactgatctgagctgcagaataccaggcagccacctcacccacccagcaggtccactcttatactttctcagaaagcacagccactctactcttattcagttgaaaagaatttccaggaaggtgtttc

SEQ ID NO: 9 - DNA, 955 bp, Homo Sapiens
  allele 478: 10-504-172 : polymorphic base A or T
  misc_binding 458..477: 10-504-172.mis1, potential
  misc_binding 479..498: 10-504-172.mis2, potential complement
  primer_bind 307..324: upstream amplification primer
  primer_bind 557..575: downstream amplification primer, complement
  misc_binding 466..490: 10-504-172 potential probe
catgaaacttcatggtgtccatgagcatgtgaaccaatttctattataaatctgcaatatatatatatgaggagacttatttatatattggttcagtttctctggagagccttggctaatataaagtctatactctacaaagtgccctaggtactcagggagtacccaagtgtgtcatgaccagcccgacagccctggctgctggcttccccgcacacaactctgcacgctgccttcatcagcctttctctctcagctgaaccgagggcattgaagcgggcctctggcactgtacctatgagggagcaatatcttcccctacactgacctcttccgtgccgagatgcagccctccctgctgccactagttacagtggtccatgttccctttcaaagtgaagttttgataaaagcacctcttaaccaatgccaaatagctaagtctgggacaaagattgcaggtattttgcattttccwtgtaacctcagagggattgccattcacactgatctgagctgcagaataccaggcagccacctcacccacccagcaggtccactcttatactttctcagaaagcacagccactctactcttattcagttgaaaagaatttccaggaaggtgtttctgcgattgcctcagaaaagtcagttccctttgggaatttcccttagggatcatctgtaactccatttctgccttttacctgaattctttggtttggtttgaattctttggtttaatttatgaattccctttattacttttctctgaagaaatggagatatcagctgtccctccccactgccatttattccttccttcattcaaaccttatgtggctgctacttaccgtgtgttaagtgttcactttttttcttggaattcaaaaaaagaaggacagtatttggggcacagatcttttggtgttctatacatttttttaaagtt

SEQ ID NO: 10 - DNA, 955 bp, Homo Sapiens
  allele 478: 10-504-243 : polymorphic base A or C
  misc_binding 458..477: 10-504-243.mis1, potential
  misc_binding 479..498: 10-504-243.mis2, potential complement
  primer_bind 237..254: upstream amplification primer
  primer_bind 487..505: downstream amplification primer, complement
  misc_binding 466..490: 10-504-243 potential probe
ggagacttatttatatattggttcagtttctctggagagccttggctaatataaagtctatactctacaaagtgccctaggtactcagggagtacccaagtgtgtcatgaccagcccgacagccctggctgctggcttccccgcacacaactctgcacgctgccttcatcagcctttctctctcagctgaaccgagggcattgaagcgggcctctggcactgtacctatgagggagcaatatcttcccctacactgacctcttccgtgccgagatgcagccctccctgctgccactagttacagtggtccatgttccctttcaaagtgaagttttgataaaagcacctcttaaccaatgccaaatagctaagtctgggacaaagattgcaggtattttgcattttccatgtaacctcagagggattgccattcacactgatctgagctgcagaataccaggcagccacctcacccacmcagcaggtccactcttatactttctcagaaagcacagccactctactcttattcagttgaaaagaatttccaggaaggtgtttctgcgattgcctcagaaaagtcagttccctttgggaatttcccttagggatcatctgtaactccatttctgccttttacctgaattctttggtttggtttgaattctttggtttaatttatgaattccctttattacttttctctgaagaaatggagatatcagctgtccctccccactgccatttattccttccttcattcaaaccttatgtggctgctacttaccgtgtgttaagtgttcactttttttcttggaattcaaaaaaagaaggacagtatttggggcacagatcttttggtgttctatacatttttttaaagtttcattttacatttgtgtgtgcgtgtgtgtgtgtgtgtgagacagtcttgctctgttgcccaggctggagt

SEQ ID NO: 11 - DNA, 955 bp, Homo Sapiens
  allele 478: 10-204-326 : polymorphic base A or G
  misc_binding 458..477: 10-204-326.mis1, potential
  misc_binding 479..497: 10-204-326.mis2, complement
  primer_bind 153..170: upstream amplification primer
  primer_bind 590..607: downstream amplification primer, complement
  misc_binding 466..490: 10-204-326 potential probe
gaattccctttattacttttctctgaagaaatggagatatcagctgtccctccccactgccatttattccttccttcattcaaaccttatgtggctgctacttaccgtgtgttaagtgttcactttttttcttggaattcaaaaaaagaaggacagtatttggggcacagatcttttggtgttctatacatttttttaaagtttcattttacatttgtgtgtgcgtgtgtgtgtgtgtgtgagacagtcttgctctgttgcccaggctggagtgcagtggcataatcattggctcactgtagcctcaaagtcctgggcccaagcgatcttcccacctcagccacccaaaatgctggggttacaggtttatgccactctgtctgacctgaaagttttgggtttactttcccttctttctctttgctgaagtcagagatgatggcagcttccagattctctggtgcctgtgctgggctcrtgctggtcatggtcttgggtccaggattcattctggagactctcagggaagtttcccatgacaaggaaatgtaggagagtgtgctggctttgcgtgctcctctgccaagccctgcttctcctggtgggacacactgaaccacagccagggcattttggtggttagttaaaaaaaaaaaaaaaaaaaaaaaaggaagaagaaggcactgtgtaattgtgccggggatcttcagaaattgtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggtaaggaaagcccttcactcagggaagaacagaaggggagattttctttgatggttgtttggaagtcagg

SEQ ID NO: 12 - DNA, 955 bp, Homo Sapiens
  allele 478: 10-32-357 : polymorphic base A or C
  misc_binding 459..477: 10-32-357.mis1
  misc_binding 479..498: 10-32-357.mis2, potential complement
  primer_bind 121..139: upstream amplification primer
  primer_bind 522..541: downstream amplification primer, complement
  misc_binding 466..490: 10-32-357 potential probe
gaagtcagagatgatggcagcttccagattctctggtgcctgtgctgggctcgtgctggtcatggtcttgggtccaggattcattctggagactctcagggaagtttcccatgacaaggaaatgtaggagagtgtgctggctttgcgtgctcctctgccaagccctgcttctcctggtgggacacactgaaccacagccagggcattttggtggttagttaaaaaaaaaaaaaaaaaaaaaaaaggaagaagaaggcactgtgtaattgtgccggggatcttcagaaattgtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggtaaggaaagcccttcamtcagggaagaacagaaggggagattttctttgatggttgtttggaagtcaggcttaaacaattgtgtctgtgtgtgcgcatgcacaaacacttttaccttatctttattttcttctttttatttgaatgtatagggttgtgtgtatttctgtgtaaatttggggttttcctcctcttagtctttcacttttgtggtgattaccagtcccatttttagagccagggctgcaacttgaaggttttgctaaaaccctcaccgaagtgtctatgatcagcattttaactattaattaatgtggccaggcaaggggtggaaggtgagaagactagaaagggaacatgatatacacatttactcagatactgggcttttctaacatctgcagtgcaattgaagttaccagtcatctgcagtctaaaaagaaagtgattttgggaggtgcgtagaaaaaatcatcttattatttttcctctata

SEQ ID NO: 13 - DNA, 955 bp, Homo Sapiens
  allele 478: 10-33-175 : polymorphic base C or T
  misc_binding 459..477: 10-33-175.mis1
  misc_binding 479..498: 10-33-175.mis2, potential complement
  primer_bind 304..322: upstream amplification primer
  primer_bind 705..723: downstream amplification primer, complement
  misc_binding 466..490: 10-33-175 potential probe
taatttctacttgttcttcagattttatcttagatgtcattccctcaaggaatccttctgtgactcaacatggaattaagttgcctcctttgaccctgaaagcaccatgtactcaatctcatcttggcatgactcactttgctgtgtggaatgtctgctttccttgtttgtctattcctttagactgtaagatcctagaaagtgggggccgtgccttgctcatgactgtgtttctaacaccaaacacagtgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagyttccagaggaccggaacacttgcctttgagcgggtctacactgccaagtgagtcctaaccctgatgttgctaataagtgggggcatgggcaggggggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttagaccagggttgctactgtgaacaccagccatgactcaccagtcaccttcagaagccacaggcaggacatgctgacgacagccttcaactcacccaccccttgctcccctgcgggtggaa

SEQ ID NO: 14 - DNA, 955 bp, Homo Sapiens
  allele 478: 10-33-211 : polymorphic base C or T
  misc_binding 458..477: 10-33-211.mis1, potential
  misc_binding 479..498: 10-33-211.mis2, potential complement
  primer_bind 268..286: upstream amplification primer
  primer_bind 669..687: downstream amplification primer, complement
  misc_binding 466..490: 10-33-211 potential probe
tcattccctcaaggaatccttctgtgactcaacatggaattaagttgcctcctttgaccctgaaagcaccatgtactcaatctcatcttggcatgactcactttgctgtgtggaatgtctgctttccttgtttgtctattcctttagactgtaagatcctagaaagtgggggccgtgccttgctcatgactgtgtttctaacaccaaacacagtgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaacacttgcctttgagcgggtytacactgccaagtgagtcctaaccctgatgttgctaataagtgggggcatgggcaggggggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttagaccagggttgctactgtgaacaccagccatgactcaccagtcaccttcagaagccacaggcaggacatgctgacgacagccttcaactcacccaccccttgctcccctgcgggtggaagtctggaggtgacaccactgcattttctaacacggg

SEQ ID NO: 15 - DNA, 955 bp, Homo Sapiens
  allele 478: 10-33-234 : polymorphic base A or C
  misc_binding 459..477: 10-33-234.mis1
  misc_binding 479..498: 10-33-234.mis2, potential complement
  primer_bind 245..263: upstream amplification primer
  primer_bind 646..664: downstream amplification primer, complement
  misc_binding 466..490: 10-33-234 potential probe
gtgactcaacatggaattaagttgcctcctttgaccctgaaagcaccatgtactcaatctcatcttggcatgactcactttgctgtgtggaatgtctgctttccttgtttgtctattcctttagactgtaagatcctagaaagtgggggccgtgccttgctcatgactgtgtttctaacaccaaacacagtgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaacacttgcctttgagcgggtctacactgccaagtgagtcctaamcctgatgttgctaataagtgggggcatgggcaggggggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttagaccagggttgctactgtgaacaccagccatgactcaccagtcaccttcagaagccacaggcaggacatgctgacgacagccttcaactcacccaccccttgctcccctgcgggtggaagtctggaggtgacaccactgcattttctaacacgggggctccttgagcaactagaacaa

SEQ ID NO: 16 - DNA, 955 bp, Homo Sapiens
  allele 478: 10-33-270 : polymorphic base A or G
  misc_binding 459..477: 10-33-270.mis1
  misc_binding 479..498: 10-33-270.mis2, potential complement
  primer_bind 209..227: upstream amplification primer
  primer_bind 610..628: downstream amplification primer, complement
  misc_binding 466..490: 10-33-270 potential probe
ctgaaagcaccatgtactcaatctcatcttggcatgactcactttgctgtgtggaatgtctgctttccttgtttgtctattcctttagactgtaagatcctagaaagtgggggccgtgccttgctcatgactgtgtttctaacaccaaacacagtgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaacacttgcctttgagcgggtctacactgccaagtgagtcctaaccctgatgttgctaataagtgggggcatgggcagggrggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttagaccagggttgctactgtgaacaccagccatgactcaccagtcaccttcagaagccacaggcaggacatgctgacgacagccttcaactcacccaccccttgctcccctgcgggtggaagtctggaggtgacaccactgcattttctaacacgggggctccttgagcaactagaacaagaacagaaagaatggggacattagcaggtgctttcc

SEQ ID NO: 17 - DNA, 955 bp, Homo Sapiens
  allele 478: 10-33-327 : polymorphic base C or T
  misc_binding 459..477: 10-33-327.mis1
  misc_binding 479..498: 10-33-327.mis2, potential complement
  primer_bind 152..170: upstream amplification primer
  primer_bind 553..571: downstream amplification primer, complement
  misc_binding 466..490: 10-33-327 potential probe
gtctgctttccttgtttgtctattcctttagactgtaagatcctagaaagtgggggccgtgccttgctcatgactgtgtttctaacaccaaacacagtgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaacacttgcctttgagcgggtctacactgccaagtgagtcctaaccctgatgttgctaataagtgggggcatgggcaggggggcctccttctaggagtgatgaccacccttaataccacatgtctgtctgagccaagyttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttagaccagggttgctactgtgaacaccagccatgactcaccagtcaccttcagaagccacaggcaggacatgctgacgacagccttcaactcacccaccccttgctcccctgcgggtggaagtctggaggtgacaccactgcattttctaacacgggggctccttgagcaactagaacaagaacagaaagaatggggacattagcaggtgctttccccctctctcattcttttctttgaataaaaaggttgtttgaaaacacctgagcggctc

SEQ ID NO: 18 - DNA, 955 bp, Homo Sapiens
  allele 478: 10-34-290 : polymorphic base G or T
  misc_binding 458..477: 10-34-290.mis1, potential
  misc_binding 479..498: 10-34-290.mis2, potential complement
  primer_bind 189..206: upstream amplification primer
  primer_bind 525..542: downstream amplification primer, complement
  misc_binding 466..490: 10-34-290 potential probe
cctctgtctgcattgctcactcttcaattccaagaagcgcaggggcaccgccaggaacaggaaccctgccagaggaatacatcaagaaaccaagtctcccttacgcatcaccgtaggaacagagttaatggattatgaacatgtgtttgctttataccattgtttgtttcccaggtggcagctggctgccccatcttattgggtagatgtaagtggaattacgaatgggatttatgtttcatgcacgatggtgattattaacttcaactttcaggtaattttcagaccacattgcactaacttggtctctgattgtttttctccttgtttgtttattctgcagccagaactgtgtagatgcgtaccccactttcctcgctgtgctctggtctgcggggctactttgcagccaaggtaactcagacttccctttgttcattctccttctataaagtgcatctcaaggaggttcaaaggkcaggctttttgttgaaaggactttgcctgacctctggctcccatctgtgaagccctggagaggtgagagccctcgggaggccgtgtttcaggcatgctctgcacccgtgcagagcgcgtgtgataatgcattgctaatgcttgctccctggtggctggctgagagctgctgtgctgacaagggtggtttaaggctaaatgtgactcagaatccttaagcagtgttagttcagatacaagggcattataaatgagagtgcctgagggatctattttgggaccgctgtcacttggctcttctgctaataagcttccagtgtggtggccctccttcaggcatgtttccactgagccacgggctggatgccacatccccggccttcccacagttatcagcagcccacaggcttgacttgagcaagttggaaagacaaatcaacttccagagttgatttaacattgagtggaaatcagtcat

SEQ ID NO: 19 - DNA, 955 bp, Homo Sapiens
  allele 478: 10-35-358 : polymorphic base G or C
  misc_binding 459..477: 10-35-358.mis1
  misc_binding 479..498: 10-35-358.mis2, potential complement
  primer_bind 120..137: upstream amplification primer
  primer_bind 526..543: downstream amplification primer, complement
  misc_binding 466..490: 10-35-358 potential probe
atttgtgttgggctgtattcaaagccatcctgggccacgtgcgacccgcaggctccgggttggacaagtttgttgtaaacaatgccatgatgccggcataaggtcgttaccagtattaggaaggttctcaggtttcctctagcccttgggctcttttcctgaagtgcgtgtgtcttctgctagattttgtgaccaatgttgattgcctaattgggctaacagcatgttttggtggctacgaaactgacacaggtgttttcatttctccacttagttcctgctgcgtttgctggactgatgtacttgtttgtgaggcaaaagtactttgtcggttacctaggagagagaacgcagaggtaggtaactgggactactaaagaactgtggagcgattcctgatttttgagcaggaagagtgacaattcaaaacagtatttgactagattcacggctccgtagcatccccttgggtgggagsgggaaggctgactaggacctctgattcttctctccctgagctttgaaggctctgaaaatacagctggggggacttgcccagttttcttattaagcaattcctccgcatggtgctggctttcaaagggtgcttcagtgctgtttgctgcacgtgccttgcagccccacaccctgcactcccgccctgcagagtctggcgctggaatgacattttaggtctgggttcccaggcctcctgagagtgaaatgtttcattgtttgtctagagaaatgagaactaaagcttgcaccttgtgataagttgtcctgaggaacatatctttcagggaccagaagaaagaatgttgggaaaataagatgcagtaagatgcagacatgacagcagggtgcagcggctcacgcctataatcccagcactttgggaggctgaggtgggtggatcacctgaggtcaggagtttgagaccagcctggccaac

SEQ ID NO: 20 - DNA, 955 bp, Homo Sapiens
  allele 478: 10-35-390 : polymorphic base C or T
  misc_binding 459..477: 10-35-390.mis1
  misc_binding 479..498: 10-35-390.mis2, potential complement
  primer_bind 88..105: upstream amplification primer
  primer_bind 494..511: downstream amplification primer, complement
  misc_binding 466..490: 10-35-390 potential probe
ggccacgtgcgacccgcaggctccgggttggacaagtttgttgtaaacaatgccatgatgccggcataaggtcgttaccagtattaggaaggttctcaggtttcctctagcccttgggctcttttcctgaagtgcgtgtgtcttctgctagattttgtgaccaatgttgattgcctaattgggctaacagcatgttttggtggctacgaaactgacacaggtgttttcatttctccacttagttcctgctgcgtttgctggactgatgtacttgtttgtgaggcaaaagtactttgtcggttacctaggagagagaacgcagaggtaggtaactgggactactaaagaactgtggagcgattcctgatttttgagcaggaagagtgacaattcaaaacagtatttgactagattcacggctccgtagcatccccttgggtgggagcgggaaggctgactaggacctctgattcttctytccctgagctttgaaggctctgaaaatacagctggggggacttgcccagttttcttattaagcaattcctccgcatggtgctggctttcaaagggtgcttcagtgctgtttgctgcacgtgccttgcagccccacaccctgcactcccgccctgcagagtctggcgctggaatgacattttaggtctgggttcccaggcctcctgagagtgaaatgtttcattgtttgtctagagaaatgagaactaaagcttgcaccttgtgataagttgtcctgaggaacatatctttcagggaccagaagaaagaatgttgggaaaataagatgcagtaagatgcagacatgacagcagggtgcagcggctcacgcctataatcccagcactttgggaggctgaggtgggtggatcacctgaggtcaggagtttgagaccagcctggccaacatggtgaaaccccgtctctactaaaaaatata

SEQ ID NO: 21 - DNA, 955 bp, Homo Sapiens
  allele 478: 10-36-164 : polymorphic base A or G
  misc_binding 458..477: 10-36-164.mis1, potential
  misc_binding 479..497: 10-36-164.mis2, complement
  primer_bind 315..334: upstream amplification primer
  primer_bind 741..760: downstream amplification primer, complement
  misc_binding 466..490: 10-36-164 potential probe
tctaacacagtcctgcattacacacgtgtctgtcgttatgggcagctgcagagagggtcttaatggtcctaatgctcagtgaggatgcccaatggtcaacagaacctgccatcttcaggccatcaaggagctctggagttaaggaaatcatgagagcacagaggggcgggtacagcagagccctcgtggtaatgggttttgaggtctaggctctcttcgcttgggtttgaaataagttcaatgactagtaatagctgagacacttctacccttcaaatgaagtaaatgggaaaatggagcattgttgagtccagggagctataatttaaaccccatatatctaaaaggggtaacatttttgtgtgtgtgaaattggtgtcattcgcactgcatctacagttttctttttccttctcttccagcacccctggctacatatttgggaaacgcatcatactcttcctgttcctcatgtccrttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgttttaagctgatagttgaggggttttgttaatggcttttgggggatttatctctataccca

SEQ ID NO: 22 - DNA, 955 bp, Homo Sapiens
  allele 478: 10-498-192 : polymorphic base A or G
  misc_binding 458..477: 10-498-192.mis1, potential
  misc_binding 479..498: 10-498-192.mis2, potential complement
  primer_bind 287..306: upstream amplification primer
  primer_bind 621..638: downstream amplification primer, complement
  misc_binding 466..490: 10-498-192 potential probe
taaaccccatatatctaaaaggggtaacatttttgtgtgtgtgaaattggtgtcattcgcactgcatctacagttttctttttccttctcttccagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccrtgcattttgtttgtttcttcacttatcctgttctctgaagatgttttgtgaccaggtttgtgttttcttaaaataaaatgcagagacatgttttaagctgatagttgaggggttttgttaatggcttttgggggatttatctctatacccacaaacgactagtttgttttcctcaaactaaatgataatattaaaaatacacatcctggccaggtgtggtggctcatacctgtaatcccagcactttgggaggccgaggcaggtggatcacttgaggtcaggaattaagaccagcctggccaatatggtgaaagcctgtctgtactaaaaatacaaaaattagccaggtatgctggtggatgcttataatcccagctacttgggaggttgaggcaggagaattgcttgaacccgggaggtagaggttgcagtgagccaagatcatgccactgcactccagcttgggcaacagagtga

SEQ ID NO: 23 - DNA, 955 bp, Homo Sapiens
  allele 478: 12-628-306 : polymorphic base G or A
  misc_binding 479..497: 12-628-306.mis1, complement
  misc_binding 458..477: 12-628-306.mis2, potential
  primer_bind 764..782: upstream amplification primer, complement
  primer_bind 266..286: downstream amplification primer
  misc_binding 466..490: 12-628-306 potential probe
atcggatatgtccctgccccctctcccaactcctcctttcgcttgctcgttcactcagttccagccacattgccctgggagctgctcccaccatggggcttcctaatgcactggtctctctcatgcagtggggcctctccctccttttactcagtgtctcccagcacccacctcctccagagccttccctgaccaccacacctacacctaggcccttcctcctccacgctccctcctccaccccggcctcctacccacgtgtcacttctttatactcgctgccacctgaaattagatcatttatttacccctttatttgttcagtttgccttgtccgttagaatataagcttccaaagggcaggagctttgcctatattgttaggccgggcatacaatgagcactcaaaaaaatatttgatgagtgtatgaaagaacagactgggttatgtaattgtgcctacttacctatatgaccrtgtggtggggtttatggtgggtgtggtggtgatggctatagggctataagcaaatttgggacagggagtctaagaaatgttcttaaattttagtaagcaaagcatcctctacagaacctgtcttaaaacatgaaagttccttagtgctacccccagaggtatgatttggtaggtcaaggatagggcctggaaattcacattcttgttaagatgttcttcatccggggtttgttgaccaccttttcagaagatttttgctctgtagctgtactacccaatgcagtagttcgtagtcagtgtggctcctgagcccttgaagtgtagctcctctgaactgagacgtgctgtaaatgtaaattgcacaccggagtttgaagagttaatacaaagaaaaaggaatgcaaaacatctcattaataatgctttacactgattacatattgaaatggtaatcttgtagatatagtgcgttaaata

SEQ ID NO: 24 - DNA, 955 bp, Homo Sapiens
  allele 478: 12-628-311 : polymorphic base T or C
  misc_binding 458..477: 12-628-311.mis1, potential
  misc_binding 479..498: 12-628-311.mis2, potential complement
  primer_bind 769..787: upstream amplification primer, complement
  primer_bind 271..291: downstream amplification primer
  misc_binding 466..490: 12-628-311 potential probe
gtgccatcggatatgtccctgccccctctcccaactcctcctttcgcttgctcgttcactcagttccagccacattgccctgggagctgctcccaccatggggcttcctaatgcactggtctctctcatgcagtggggcctctccctccttttactcagtgtctcccagcacccacctcctccagagccttccctgaccaccacacctacacctaggcccttcctcctccacgctccctcctccaccccggcctcctacccacgtgtcacttctttatactcgctgccacctgaaattagatcatttatttacccctttatttgttcagtttgccttgtccgttagaatataagcttccaaagggcaggagctttgcctatattgttaggccgggcatacaatgagcactcaaaaaaatatttgatgagtgtatgaaagaacagactgggttatgtaattgtgcctacttacctataygaccatgtggtggggtttatggtgggtgtggtggtgatggctatagggctataagcaaatttgggacagggagtctaagaaatgttcttaaattttagtaagcaaagcatcctctacagaacctgtcttaaaacatgaaagttccttagtgctacccccagaggtatgatttggtaggtcaaggatagggcctggaaattcacattcttgttaagatgttcttcatccggggtttgttgaccaccttttcagaagatttttgctctgtagctgtactacccaatgcagtagttcgtagtcagtgtggctcctgagcccttgaagtgtagctcctctgaactgagacgtgctgtaaatgtaaattgcacaccggagtttgaagagttaatacaaagaaaaaggaatgcaaaacatctcattaataatgctttacactgattacatattgaaatggtaatcttgtagatatagtgcgtt

SEQ ID NO: 25 - DNA, 955 bp, Homo Sapiens
  allele 478: 12-629-241 : polymorphic base G or C
  misc_binding 459..477: 12-629-241.mis1
  misc_binding 479..498: 12-629-241.mis2, potential complement
  primer_bind 238..257: upstream amplification primer
  primer_bind 617..637: downstream amplification primer, complement
  misc_binding 466..490: 12-629-241 potential probe
  misc_feature 137: n=a, g, c or t
ggtatttgtggggtgcatgtgatactttattatgtgtgtggattgtgtaatgatgaagtcagggcatttagggtcttcatcaccttgattatcatttctatgtgttgagaacatttcaagttctcagttccagctanttttgaaatagacagtccattttgttagctacagtcacccaacccggctgtcagacattggaacttactcctattgaactgtgtatttgtacccattcaccaaactctctttgggctttcagttttacaactgggatgatcctgggaaaactaaagtaaatcagacacccgacgtgtgagctaggttataatatgcccagtggaccctggggacatcttagctttcagaggtcatgctgtccaagctgactgtggggcttccagaaggtggggagaggaaatgatgcaatggcccatcagaggcactacttggggcctggggccagagtgcatgtctaagscattaaggggaggggagagcagccttcataattatgaagaggagtctcaggtgcacagcttctgatgagggacagcttctaattgaagacagcattgtgtaatgctcaaactccctgtcttcagagtgcctgctgtatcccaccatcagttctgtgacttctccctaagcctcaattttgcatgtgttacattgggataataatagtgccaaactcatggggttgtgaggaataatgaggtaaagcaattgaaaaggtttagcacaatataagtgctcaataaaagccattattattattttattacactagttttcaattcctgcatagcaaattcttgcaaatgtagggactcaaaacaatataaatttattatctgacagtttttctgggtcagaggtcttactaggctgtaatcagagggcaaccaaagctgtgatctcagctgaagctcaggattctcttccaagctcactg

SEQ ID NO: 26 - DNA, 956 bp, Homo Sapiens
  allele 478: 12-206-366 : polymorphic base C or T
  misc_binding 459..477: 12-206-366.mis1
  misc_binding 479..498: 12-206-366.mis2, potential complement
  primer_bind 222..239: upstream amplification primer
  primer_bind 635..654: downstream amplification primer, complement
  misc_binding 466..490: 12-206-366 potential probe
  misc_feature 193: n=a, g, c or t
cggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcanctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtyggggaaggaggcacaaggtcccgggaactgctgcggggctaggagggcagagttaaggacggtcggagcagacttagaggatgtatgggcccagggcaggtgaaatgtagggatcccagggtgctggacagaaaacgggaaggagttatgaattcccaaagttttacacaggctaagagaggctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcag

SEQ ID NO: 27 - DNA, 956 bp, Homo Sapiens
  allele 478: 10-343-339 : polymorphic base G or T
  misc_binding 458..477: 10-343-339.mis1, potential
  misc_binding 479..498: 10-343-339.mis2, potential complement
  primer_bind 140..157: upstream amplification primer
  primer_bind 553..572: downstream amplification primer, complement
  misc_binding 466..490: 10-343-339 potential probe
  misc_feature 111: n=a, g, c or t
ctccacccgactccgggcgtctgagacccaaagagcaggttgtgcgggggcgggaacgaggcgatgctgtctttggaggccctgagaaactgaggttgcacaggagcgcanctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtcggggaaggaggcacaaggtcccgggaactgctgcggggctaggagggcagagttaaggacggtcggagcagacttagaggakgtatgggcccagggcaggtgaaatgtagggatcccagggtgctggacagaaaacgggaaggagttatgaattcccaaagttttacacaggctaagagaggctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagacgaggaggaatgaggatggcaaatagtgaatttttttttttttttttttgagatggagtcttgctttgttgcccaggc

SEQ ID NO: 28 - DNA, 956 bp, Homo Sapiens
  allele 478: 10-347-74 : polymorphic base A or G
  misc_binding 458..477: 10-347-74.mis1, potential
  misc_binding 479..498: 10-347-74.mis2, potential complement
  primer_bind 405..422: upstream amplification primer
  primer_bind 826..845: downstream amplification primer, complement
  misc_binding 466..490: 10-347-74 potential probe
  misc_feature 461,553: n=a, g, c or t
gaatggacactgaaggcagggtgagaaaaaggctagacctcgaagtgaaataagggctgggagggccaagaatgatgatagacggtgagggactgagggatcagctgatgagttaagcctcaatacctgtcctagggctctggagatggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacanatatcctcctttcaccrcccaccaaagagaaggttcgccagtgctggcaggatgatgagttgttcagctaccagttcctcaatggtgccaancccatgctgttgagacgctcgacctctctgccctccaggctagtgctgccctcggggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgagg

SEQ ID NO: 29 - DNA, 956 bp, Homo Sapiens
  allele 478: 10-347-111 : polymorphic base G or C
  misc_binding 458..477: 10-347-111.mis1, potential
  misc_binding 479..498: 10-347-111.mis2, potential complement
  primer_bind 368..385: upstream amplification primer
  primer_bind 789..808: downstream amplification primer, complement
  misc_binding 466..490: 10-347-111 potential probe
  misc_feature 424,516: n=a, g, c or t
cctcgaagtgaaataagggctgggagggccaagaatgatgatagacggtgagggactgagggatcagctgatgagttaagcctcaatacctgtcctagggctctggagatggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacanatatcctcctttcaccgcccaccaaagagaaggttcgccagtgctggcaggatsatgagttgttcagctaccagttcctcaatggtgccaancccatgctgttgagacgctcgacctctctgccctccaggctagtgctgccctcggggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttct

SEQ ID NO: 30 - DNA, 956 bp, Homo Sapiens
  allele 478: 10-347-165 : polymorphic base C or T
  misc_binding 458..477: 10-347-165.mis1, potential
  misc_binding 479..498: 10-347-165.mis2, potential complement
  primer_bind 314..331: upstream amplification primer
  primer_bind 735..754: downstream amplification primer, complement
  misc_binding 466..490: 10-347-165 potential probe
  misc_feature 370,462: n=a, g, c or t
actgagggatcagctgatgagttaagcctcaatacctgtcctagggctctggagatggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacanatatcctcctttcaccgcccaccaaagagaaggttcgccagtgctggcaggatgatgagttgttcagctaccagttcctcaatggtgccaancccatgctgttgagaygctcgacctctctgccctccaggctagtgctgccctcggggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctagg

SEQ ID NO: 31 - DNA, 956 bp, Homo Sapiens
  allele 478: 10-347-203 : polymorphic base A or G
  misc_binding 459..477: 10-347-203.mis1
  misc_binding 479..498: 10-347-203.mis2, potential complement
  primer_bind 276..293: upstream amplification primer
  primer_bind 697..716: downstream amplification primer, complement
  misc_binding 466..490: 10-347-203 potential probe
  misc_feature 332,424: n=a, g, c or t
tcctagggctctggagatggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacanatatcctcctttcaccgcccaccaaagagaaggttcgccagtgctggcaggatgatgagttgttcagctaccagttcctcaatggtgccaancccatgctgttgagacgctcgacctctctgccctccaggctagtgctgccctcrgggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctaggcaaaatgtgtgcgtatgcatgtgtgtgctgtatgcggt

SEQ ID NO: 32 - DNA, 956 bp, Homo Sapiens
  allele 478: 10-347-220 : polymorphic base A or G
  misc_binding 458..477: 10-347-220.mis1, potential
  misc_binding 479..497: 10-347-220.mis2, complement
  primer_bind 259..276: upstream amplification primer
  primer_bind 680..699: downstream amplification primer, complement
  misc_binding 466..490: 10-347-220 potential probe
  misc_feature 315,407: n=a, g, c or t
tggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacanatatcctcctttcaccgcccaccaaagagaaggttcgccagtgctggcaggatgatgagttgttcagctaccagttcctcaatggtgccaancccatgctgttgagacgctcgacctctctgccctccaggctagtgctgccctcggggatggaagagcttcrggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctaggcaaaatgtgtgcgtatgcatgtgtgtgctgtatgcggtggcaggggtagtagggg

SEQ ID NO: 33 - DNA, 956 bp, Homo Sapiens
  allele 478: 10-347-271 : polymorphic base A or T
  misc_binding 458..477: 10-347-271.mis1, potential
  misc_binding 479..498: 10-347-271.mis2, potential complement
  primer_bind 209..226: upstream amplification primer
  primer_bind 630..649: downstream amplification primer, complement
  misc_binding 466..490: 10-347-271 potential probe
  misc_feature 265,357: n=a, g, c or t
gactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacanatatcctcctttcaccgcccaccaaagagaaggttcgccagtgctggcaggatgatgagttgttcagctaccagttcctcaatggtgccaancccatgctgttgagacgctcgacctctctgccctccaggctagtgctgccctcggggatggaagagcttcaggctcaactggagaaagaacttcaggtacctctccttcccctgcctggcwctgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctaggcaaaatgtgtgcgtatgcatgtgtgtgctgtatgcggtggcaggggtagtaggggaagctctctggaatatttggcagaggacgtgagatttgaatagggaatga

SEQ ID NO: 34 - DNA, 956 bp, Homo Sapiens
  allele 478: 10-347-348 : polymorphic base A or G
  misc_binding 458..477: 10-347-348.mis1, potential
  misc_binding 479..498: 10-347-348.mis2, potential complement
  primer_bind 132..149: upstream amplification primer
  primer_bind 553..572: downstream amplification primer, complement
  misc_binding 466..490: 10-347-348 potential probe
  misc_feature 188,280: n=a, g, c or t
atggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacanatatcctcctttcaccgcccaccaaagagaaggttcgccagtgctggcaggatgatgagttgttcagctaccagttcctcaatggtgccaancccatgctgttgagacgctcgacctctctgccctccaggctagtgctgccctcggggatggaagagcttcaggctcaactggagaaagaacttcaggtacctctccttcccctgcctggcactgttctctccttagtagtgtggtgagaacggacagagagaatccaaactgagtcagaggaaggctgcagtactgcrttgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctaggcaaaatgtgtgcgtatgcatgtgtgtgctgtatgcggtggcaggggtagtaggggaagctctctggaatatttggcagaggacgtgagatttgaatagggaatgaaagagcatttgctgagctgataggagccaaaaccagagcgcagaccattcgggaatgatcagaaaggggcctggcca

SEQ ID NO: 35 - DNA, 956 bp, Homo Sapiens
  allele 478: 10-348-391 : polymorphic base A or G
  misc_binding 458..477: 10-348-391.mis1, potential
  misc_binding 479..498: 10-348-391.mis2, potential complement
  primer_bind 90..109: upstream amplification primer
  primer_bind 488..507: downstream amplification primer, complement
  misc_binding 466..490: 10-348-391 potential probe
  misc_feature 906: n=a, g, c or t
ccctcaccagactgtttcttcactttaagatgagaggaactggaccaggggctctagttctcccaacagggctccggtactgatgcaggagaatggcaagaagctagactaaatctcttgccctttgccccggccccctgggggtagactttgaactctaaaaatggatacatccctcctgtccccagaatggttccctgtttgaagctgacttcatccttctggatggaattccagccaacgtgatccgaggagagaagcaatacctggctgcccccctcgttatgctgaagatggagcccaatgggaagctgcagcccatggtcatccaggtaagggccccagacctctcccacaacgttgcactctgttcacctcaacctctgctcccagggacccaacccccagctcttggctcccaaaccccatcctcactcagtgagacttgtcttcatgtcactatttgcctgtaccctcrtctcccctgcctcatccaactagaattactttttcaagagtcaaaatggcctcttggagttctcatcctgtatccaatggtcctcacacttcagtgtgcatcagaatcacctgaatgcctgttgaaatgcagatttctggatcccatgaccagactttctgattcagtatgtctggggtgggaactaagagtttgcgtttttataagttccaaagtgatgctgacactaccagttcaggactacactttcagaatcactatctcatctctcagtggcctctggctctgaaccctcgccatctcttgaatatcttttctcgcaatttcttttttttttttgagacagaatctcactgtgtcactcaggctggaatacagttgtgtgatcttggctcactgcaacctgcgcctcctgggttcaagcaatntctcccacctcagtccctccagtagctgggaccacaggcatgtgccacca

SEQ ID NO: 36 - DNA, 956 bp, Homo Sapiens
  allele 478: 10-349-47 : polymorphic base C or T
  misc_binding 458..477: 10-349-47.mis1, potential
  misc_binding 479..498: 10-349-47.mis2, potential complement
  primer_bind 432..451: upstream amplification primer
  primer_bind 829..848: downstream amplification primer, complement
  misc_binding 466..490: 10-349-47 potential probe
aggcatgtgccaccatgtgggcctggctaatttttgtattttttgtagagatggggtttcgccatattgcccaggctggtcttgaacttctgggctcaagtaatctgcctgcctcggcctcccaaagtgctgggattacagctgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatayacggaatgggagttcaataatttctctttctcccagattcagcctcccagccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagatattgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctc

SEQ ID NO: 37 - DNA, 956 bp, Homo Sapiens
  allele 478: 10-349-97 : polymorphic base A or G
  misc_binding 458..477: 10-349-97.mis1, potential
  misc_binding 479..497: 10-349-97.mis2, complement
  primer_bind 382..401: upstream amplification primer
  primer_bind 779..798: downstream amplification primer, complement
  misc_binding 466..490: 10-349-97 potential probe
atggggtttcgccatattgcccaggctggtcttgaacttctgggctcaagtaatctgcctgcctcggcctcccaaagtgctgggattacagctgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccarccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagatattgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctacctt

SEQ ID NO: 38 - DNA, 956 bp, Homo Sapiens
  allele 478: 10-349-142 : polymorphic base G or C
  misc_binding 458..477: 10-349-142.mis1, potential
  misc_binding 479..498: 10-349-142.mis2, potential complement
  primer_bind 337..356: upstream amplification primer
  primer_bind 734..753: downstream amplification primer, complement
  misc_binding 466..490: 10-349-142 potential probe
tcaagtaatctgcctgcctcggcctcccaaagtgctgggattacagctgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccagccccagctctccaaccccaacactgttcctgccctcagacccccsacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagatattgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctaccttagatctagtatttagccagaaaaacaagtgatgcccataagaacc

SEQ ID NO: 39 - DNA, 956 bp, Homo Sapiens
  allele 478: 10-349-224 : polymorphic base G or T
  misc_binding 458..477: 10-349-224.mis1, potential
  misc_binding 479..497: 10-349-224.mis2, complement
  primer_bind 255..274: upstream amplification primer
  primer_bind 652..671: downstream amplification primer, complement
  misc_binding 466..490: 10-349-224 potential probe
ttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccagccccagctctccaaccccaacactgttcctgccctcagaccccccacttgcctggctcctggcaaagtcctgggtccgaaattcagatttccaactgcacgagatccagtatcacttgctgaacackcacctggtggctgaggtcatcgctgtcgccaccatgcggtgcctcccaggactgcaccccatcttcaaggtacttattaatctattaaatcacatatccctcagaccccagagagaggaacagccccatatcaaaagatattgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaagggacagcctataacagtatagtattgatgaagaatgtttc

SEQ ID NO: 40 - DNA, 956 bp, Homo Sapiens
  allele 478: 10-349-368 : polymorphic base C or T
  misc_binding 458..477: 10-349-368.mis1, potential
  misc_binding 479..498: 10-349-368.mis2, potential complement
  primer_bind 114..133: upstream amplification primer
  primer_bind 511..530: downstream amplification primer, complement
  misc_binding 466..490: 10-349-368 potential probe
ccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccagccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagataytgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaagggacagcctataacagtatagtattgatgaagaatgtttctacccaattgaggagtcagctaagtagaaacagaccaaaaggcaaggaagaacagccagcaagccgctcatacctgcccaacagtaaggtggatagagatgtatgttagcatggtaatgacaggaatgaaaaggaaagaat

SEQ ID NO: 41 - DNA, 956 bp, Homo Sapiens
  allele 478: 10-339-32 : polymorphic base C or T
  misc_binding 458..477: 10-339-32.mis1, potential
  misc_binding 479..498: 10-339-32.mis2, potential complement
  primer_bind 447..464: upstream amplification primer
  primer_bind 845..864: downstream amplification primer, complement
  misc_binding 466..490: 10-339-32 potential probe
  misc_feature 703: n=a, g, c or t
tgcctcagcctcccgagtacctgggactacaggtgcccgccaccacacctggctaacttttcgtatttttagtagagacggggtttcaccgtgttagccaggatggtctcgatctcctgacctcgtgatccgcccatcttggcctccccaagtgctgggactacaggcgtgagccaccgcgcccggccgcatccctcaattcttaaccactttttgaggcaagggatatttggtcactcagaacttttcagcccccaatccttccataacaataattattacttacttattgagcatttattacagaccaggtgattttgatacatcatctcatttataatgtaggtatcgtccatattttacaggtgaaaaaaactgaggttcaaataggttaagctggcctatggtaactaagtgtaagtgactgagccaggacttaaacgcatgtctgatgcaaatacgtctaaataaaataaayaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccaggtatggacagctgaaagcccaggtcnatgaaggcaaggtgacctgagggagagatgggagttcaaaccctaagtaccagggttctagggttacagtttcttcctccagctggactggtatgcctgggtccctaatgctccatgcacaatgcggatgcccccacccaccaacaaggaagatgtgacgatggccacagtgatggggtcactacctgatgtccggcaggcctgtcttcaaatggccatctcatggcatctgagtcgccgccagccagacatg

SEQ ID NO: 42 - DNA, 956 bp, Homo Sapiens
  allele 478: 10-341-116 : polymorphic base A or G
  misc_binding 458..477: 10-341-116.mis1, potential
  misc_binding 479..497: 10-341-116.mis2, complement
  primer_bind 363..380: upstream amplification primer
  primer_bind 771..789: downstream amplification primer, complement
  misc_binding 466..490: 10-341-116 potential probe
  misc_feature 18: n=a, g, c or t
agctgaaagcccaggtcnatgaaggcaaggtgacctgagggagagatgggagttcaaaccctaagtaccagggttctagggttacagtttcttcctccagctggactggtatgcctgggtccctaatgctccatgcacaatgcggatgcccccacccaccaacaaggaagatgtgacgatggccacagtgatggggtcactacctgatgtccggcaggcctgtcttcaaatggccatctcatggcatctgagtcgccgccagccagacatggtgagaggggactctcgggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctrgaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaa

SEQ ID NO: 43 - DNA, 956 bp, Homo Sapiens
  allele 478: 10-341-319 : polymorphic base C or T
  misc_binding 458..477: 10-341-319.mis1, potential
  misc_binding 479..498: 10-341-319.mis2, potential complement
  primer_bind 160..177: upstream amplification primer
  primer_bind 568..586: downstream amplification primer, complement
  misc_binding 466..490: 10-341-319 potential probe
ctgatgtccggcaggcctgtcttcaaatggccatctcatggcatctgagtcgccgccagccagacatggtgagaggggactctcgggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctccccyagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaacaaatgtgctttgtttgagacatgcacagccaggctacagactggatttggcccttgaaccctgcactagcctgaggccctgaccctacttccaaaacatccaagatcatggagcagggggatttcttagaaaaatcagcttacctcagctaactctccattcccaggaactaaccttcatgcctggtggccaatgtacaaat

SEQ ID NO: 44 - DNA, 469 bp, Homo Sapiens
  allele 119: 12-196-119 : polymorphic base C or T
  misc_binding 100..118: 12-196-119.mis1
  misc_binding 120..139: 12-196-119.mis2, potential complement
  primer_bind 1..20: upstream amplification primer
  primer_bind 450..469: downstream amplification primer, complement
  misc_binding 107..131: 12-196-119 potential probe
gtatgaggatcatccatttgacagacttgccagagattttatagagaagtgagtcagggaggagaagagtagatgagcgatgggggaaaatgtgagccttgttggctgttattaaggayttgtttttactctgagtcagagatgcagactttgaaggggttggagcagaggaatgacataacctgacatatgttaactgtaacggtgtggcttttgtgttgtgaatttgatgaaacaagctggaaacagagagtctaggtaagaagctgctgtcatatccaggtgagaaatgaggtggtcagaagtgttgtgattctggatatattgtgaaggtagagcagacagaatttcgctgataaattgcttgcgggtttcatgaaaaaaatagttcttctagtccccaaaataaactaaacattgagcattttctataaattgctgactccctagaaaaacaactctaaccctg

SEQ ID NO: 45 - DNA, 399 bp, Homo Sapiens
  allele 243: 12-197-244 : polymorphic base C or T
  misc_binding 224..242: 12-197-244.mis1
  misc_binding 244..263: 12-197-244.mis2, potential complement
  primer_bind 1..19: upstream amplification primer
  primer_bind 380..399: downstream amplification primer, complement
  misc_binding 231..255: 12-197-244 potential probe
accgtaagacactcctatcagcaccatgacaatgtaccattgccacagcaacacccagaagttactgcccatttcctagctattcctgaataacgtgcccctttaattagcatgtcactaaaagtgggcataaatatggctgcacaccaccctgcactgtcctctcggattgcctccgctgtagtcctgctccccgggagcggtcacagagctgtgacacagccgcctcctcagtaaagttgytttcttccagcactggcttgctcttgaattctttcccgagcaaagccaagatcctgcccttcatcaatactaggttagatggaaaggggaactgtagcctacagtacctgcaggaatacatagaagacttctccctcaggaggaagaaagagcatg

SEQ ID NO: 46 - DNA, 400 bp, Homo Sapiens
  allele 128: 12-198-128 : polymorphic base A or G
  misc_binding 108..127: 12-198-128.mis1, potential
  misc_binding 129..148: 12-198-128.mis2, potential complement
  primer_bind 1..20: upstream amplification primer
  primer_bind 380..400: downstream amplification primer, complement
  misc_binding 116..140: 12-198-128 potential probe
  misc_feature 249: n=a, g, c or t
gtctaaagttgaggagatgggatgtcccagatgatagggctcctgggatttcagacccaagaccagcaggactccagtcacctctaccccagctctccaggacacagcgctcccaactctgagtgacrtcccacctctggtccttgcagcacaaccaacgtgggaatcacaccctccagacctcccacaggtaatggtgctgccggtgccggtgagacccaggggacaggggatgtcagaggaagcagngagagggggactttgggtcttgggtgggactaaatgaaaataaatataaggcggcagtgtggggtttaattactacgtggagatttgagactctgttcccttcactggattctagattgggttacggcagccacaatcccctgtcataaac

SEQ ID NO: 47 - DNA, 956 bp, Homo Sapiens
  allele 478: 12-206-81 : polymorphic base A or G
  misc_binding 458..477: 12-206-81.mis1, potential
  misc_binding 479..498: 12-206-81.mis2, potential complement
  primer_bind 398..415: upstream amplification primer
  primer_bind 835..854: downstream amplification primer, complement
  misc_binding 466..490: 12-206-81 potential probe
  misc_feature 147,479: n=a, g, c or t
ggcagcggggaccccgggcccaggcccgggccgagctgggctcgcggcgggagggcgggaggctgggggcgaggtgacagcgcgacctcgcggactgggacttccacgaagctgggacgaggtgggcaagatcagggacagggtccncagctgggatcccgggctgggctcaaccccatctccctttcccgcccctggtcccggcagcccccagctccttctcccagtgacccagagccaatgtaagtatgaggccagaggtcagacgtgaagctcctccaagaaccggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcrnctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtcggggaaggaggcacaaggtcccgggaactgctgcggggctaggagggcagagttaaggacggtcggagcagacttagaggatgtatgggcccagggcaggtgaaatgtagggatcccagggtgctggacagaaaacgggaaggagttatgaattcccaaagttttacacaggctaagagaggctgcgtgtga

SEQ ID NO: 48 - DNA, 507 bp, Homo Sapiens
  allele 35: 12-208-35 : polymorphic base A or T
  misc_binding 16..34: 12-208-35.mis1
  misc_binding 36..55: 12-208-35.mis2, potential complement
  primer_bind 1..21: upstream amplification primer
  primer_bind 487..507: downstream amplification primer, complement
  misc_binding 23..47: 12-208-35 potential probe
caattttcctcctattattcctagtttcatttcawtgtgattggaaaagatatttcatatgatttcaatcttcgtaaatttgttaagacttattttgttgcttaacatgtgatctatcctggagaatgttccatgtgggcttaagaagaatgtgtattttgcttctgttggatagaatgtcacgtatatgttcattggatctgtttggtatctagtgtttaattccactgtttccttatttattttctgtctggatgatccaaccattgttgagtgggggtattgatttcttctattatgtattgctgttttatgtcttcctgatgaattgacccttttgttagtatatataatgaccttctttgtctcttatgacagtttttgacctgaagtctattttgtcacatgtaagtatagccacctttgctctctttggttatcatttttatgggatgtgtttttcatccattcactttcaggctatttgtgtcttaaatctaaagtgag

SEQ ID NO: 49 - DNA, 448 bp, Homo Sapiens
  allele 129: 12-214-129 : polymorphic base C or T
  misc_binding 110..128: 12-214-129.mis1
  misc_binding 130..149: 12-214-129.mis2, potential complement
  primer_bind 1..20: upstream amplification primer
  primer_bind 429..448: downstream amplification primer, complement
  misc_binding 117..141: 12-214-129 potential probe
aatggtgaggaaggtatggggagtacctggccctacttttctgcccatggcccactgggcagagcctcagcctctccaccctatcctatttctccccaatcagcctccactgaagggacctgctgcccygtcaactgggtggagcaccaagacagctgctactggttctctcactctgggatgtcctgggccgaggctgagaagtactgccagctgaagaacgcccacctggtggtcatcaactccagggaggagcaggtgagggcttctggtactcagttcctaagacatgtcccatttagggaaatggttcttaagcttggccgcacattggaatcatctgggagcttccagaatgactgtcatctgtgccacaccctcagagatttaataggcctgagcatccagagaaacatctccaaactcctcagttgatttaacgaagagc

SEQ ID NO: 50 - DNA, 448 bp, Homo Sapiens
  allele 151: 12-214-151 : polymorphic base G or C
  misc_binding 131..150: 12-214-151.mis1, potential
  misc_binding 152..171: 12-214-151.mis2, potential complement
  primer_bind 1..20: upstream amplification primer
  primer_bind 429..448: downstream amplification primer, complement
  misc_binding 139..163: 12-214-151 potential probe
aatggtgaggaaggtatggggagtacctggccctacttttctgcccatggcccactgggcagagcctcagcctctccaccctatcctatttctccccaatcagcctccactgaagggacctgctgccctgtcaactgggtggagcaccaasacagctgctactggttctctcactctgggatgtcctgggccgaggctgagaagtactgccagctgaagaacgcccacctggtggtcatcaactccagggaggagcaggtgagggcttctggtactcagttcctaagacatgtcccatttagggaaatggttcttaagcttggccgcacattggaatcatctgggagcttccagaatgactgtcatctgtgccacaccctcagagatttaataggcctgagcatccagagaaacatctccaaactcctcagttgatttaacgaagagc

SEQ ID NO: 51 - DNA, 448 bp, Homo Sapiens
  allele 358: 12-214-360 : polymorphic base G or C
  misc_binding 338..357: 12-214-360.mis1, potential
  misc_binding 359..378: 12-214-360.mis2, potential complement
  primer_bind 1..20: upstream amplification primer
  primer_bind 429..448: downstream amplification primer, complement
  misc_binding 346..370: 12-214-360 potential probe
aatggtgaggaaggtatggggagtacctggccctacttttctgcccatggcccactgggcagagcctcagcctctccaccctatcctatttctccccaatcagcctccactgaagggacctgctgccctgtcaactgggtggagcaccaagacagctgctactggttctctcactctgggatgtcctgggccgaggctgagaagtactgccagctgaagaacgcccacctggtggtcatcaactccagggaggagcaggtgagggcttctggtactcagttcctaagacatgtcccatttagggaaatggttcttaagcttggccgcacattggaatcatctgggagcttccagaatsactgtcatctgtgccacaccctcagagatttaataggcctgagcatccagagaaacatctccaaactcctcagttgatttaacgaagagc

SEQ ID NO: 52 - DNA, 499 bp, Homo Sapiens
  allele 466: 12-215-467 : polymorphic base G or T
  misc_binding 446..465: 12-215-467.mis1, potential
  misc_binding 467..486: 12-215-467.mis2, potential complement
  primer_bind 1..20: upstream amplification primer
  primer_bind 479..499: downstream amplification primer, complement
  misc_binding 454..478: 12-215-467 potential probe
  misc_feature 87: n=a, g, c or t
gttgattgttttctttgctgtgtagaaactttttagtttgatataattctatttatttttgctgttgttgcttgtgcttttggtacnatatccaaaaatggatatggattttgatggaccccccaaattattgtcaaaaccaatgtcatagagctttcctgtatgttttcttctaacatttttatgatttcaggtcttacatttaagtctttaatccattttgagttgacttttgtgtatgttataaataaggtctaatttcattttttttaatgtttatgttcagctcttttgtttttgctcacaatttctttagatattagaagtcttttgtagctcaatacaagttttaggatttcttttttctatttcagtgaaaaatgccattggaattttgaaaggggttgcagcgaatctttagatcactttgggtagtagagacattttgataatattgatttttcckattcatggacatgggattttgtgaaataggttt

SEQ ID NO: 53 - DNA, 486 bp, Homo Sapiens
  allele 418: 12-216-421 : polymorphic base A or G
  misc_binding 398..417: 12-216-421.mis1, potential
  misc_binding 419..437: 12-216-421.mis2, complement
  primer_bind 1..20: upstream amplification primer
  primer_bind 467..486: downstream amplification primer, complement
  misc_binding 406..430: 12-216-421 potential probe
gatgactttgacaaatatgcatgcctaggtgactaccactccgatcgcaatagataacattgccatcgcccccaccagtcccctcatgcctctgggcagtccaaccacttccctgtttccaggccagtgatctacttctttttcactatttattggccttgcctcttctagagcttctagaacttcatataagtgaaatcatacactctcgtgtatatacttcatataagtgaatatatactctcgtgagaacttacgtactttgtgttgcttgatttttggcaatctaaaaatggcagagtggagaagccaggtgaagccttcgaaagtcctatgtgattgagaaaatagcattttcttctcatatagatttgagttcaaatcttttctgtcacttaaagatggtataaacttaggrtgattaggaaaagccattgtttaatttctctgaagatcccagagttgttggagatatgtagataagat

SEQ ID NO: 54 - DNA, 485 bp, Homo Sapiens
  allele 229: 12-219-230 : polymorphic base A or G
  misc_binding 209..228: 12-219-230.mis1, potential
  misc_binding 230..248: 12-219-230.mis2, complement
  primer_bind 1..20: upstream amplification primer
  primer_bind 465..485: downstream amplification primer, complement
  misc_binding 217..241: 12-219-230 potential probe
agctgagcttcttcccagtccctgccccactttgagtatgcttaatgtatggagcctgtcaccaactgaatgccctaatttaacgtaatcccactccaagcattccagcttctcagagctgtgacaacctcccctttctgcccctccctggtgcctgcaacctgccccacatcatcctctcccaatcaggctgaattgtttgattttgttttcactgtgggggtgaccrttatagcatgatcttattcatttatytgatggcttttaatttaaatcatacaatgtatgcaggtagaaaaatccaagcagtgcagaaagacattaaatgaaaggcctacagtagataatatttggagcagccaatgaagtctctttgtcaccatcatcaaacccctgtgtaagcattatcctgccccaccactcaggcctcagtgacagctctccttagtcacagccctaaattggggtgggtatgaacaatagac

SEQ ID NO: 55 - DNA, 485 bp, Homo Sapiens
  allele 255: 12-219-256 : polymorphic base C or T
  misc_binding 235..254: 12-219-256.mis1, potential
  misc_binding 256..275: 12-219-256.mis2, potential complement
  primer_bind 1..20: upstream amplification primer
  primer_bind 465..485: downstream amplification primer, complement
  misc_binding 243..267: 12-219-256 potential probe
agctgagcttcttcccagtccctgccccactttgagtatgcttaatgtatggagcctgtcaccaactgaatgccctaatttaacgtaatcccactccaagcattccagcttctcagagctgtgacaacctcccctttctgcccctccctggtgcctgcaacctgccccacatcatcctctcccaatcaggctgaattgtttgattttgttttcactgtgggggtgaccattatagcatgatcttattcatttatytgatggcttttaatttaaatcatacaatgtatgcaggtagaaaaatccaagcagtgcagaaagacattaaatgaaaggcctacagtagataatatttggagcagccaatgaagtctctttgtcaccatcatcaaacccctgtgtaagcattatcctgccccaccactcaggcctcagtgacagctctccttagtcacagccctaaattggggtgggtatgaacaatagac

SEQ ID NO: 56 - DNA, 956 bp, Homo Sapiens
  allele 478: 12-220-48 : polymorphic base G or A
  misc_binding 458..477: 12-220-48.mis1, potential
  misc_binding 479..498: 12-220-48.mis2, potential complement
  primer_bind 505..525: upstream amplification primer, complement
  primer_bind 76..96: downstream amplification primer
  misc_binding 466..490: 12-220-48 potential probe
aaaaaaaccacacaccatagactgggtggcttataaacaacagaaatgtattcctcacagttctggaggctgaaagttcaagatcaggttctggtgagacccctcttccaggctgcccacagccgatttctccctgtatcctcacacagcagaaagatagcaagctagcactctgtcctctgctcataaaggtatcaaacccattcaggagggctgcaccctcacaccctaattatcatgtggggctccacctccaaataccatcacaataggattagatttcaatataaaaatttttcggagccaaagacattcagttcatgacacatgttaactttaacctccactaaccaccctcccccctgttctctttcagttctcatagctcacttttgtctagttttcccagcagacattttagaggctaaaattaaaaatgccatgggattagcagtcaggaacctgagttcaagatcarcctctgccttttcccaactatgcagtcctgacagtttattctctatgggctttgattttcttacctataaaatgagagtaattatatttattccacttaactgataagattattgggtctcccagcactttaggaggccaaggtgggcagatcacctgaggccaggagttccagaccagcctagccaacacggtgaaactccatctctactaaaaatacaaaaattagctgggcatggtggtgggagcctgtaatcccagctacttgggaggctgaggcaggagaatcacttgaacctgagaggcggaggttacagtgagccgagattgtgccactgcactccagcctgggcaacagagcaagactccgtctcaaaaaaaaaaaaaagattatcgggtctctgagcccccatatccactgcaaaatgagtggactgagataacctttgtgggagcccctctcagctgtgacactggaa

SEQ ID NO: 57 - DNA, 407 bp, Homo Sapiens
  allele 302: 12-221-302 : polymorphic base A or C
  misc_binding 282..301: 12-221-302.mis1, potential
  misc_binding 303..322: 12-221-302.mis2, potential complement
  primer_bind 1..21: upstream amplification primer
  primer_bind 387..407: downstream amplification primer, complement
  misc_binding 290..314: 12-221-302 potential probe
gatgaactgagactaggaatggagtaattctgttccagaagctcacaaggaacagaatgagatgagactgccttggacgtctgtagaaaaactgtttagatggcagttgcaaaaaaactgaaaggaattgttcccatacatcagcaaaactgttgagctacagtcctcattgggttctgtccctctatcagagggacatgagtgaataggaagtgacctcatttgccattatgctcccctgccctctgaccactcacattaatccagaaatctttaccagttcacaacatccaatcagagcmaatactgaggtagaggcaggtctctacttctcgacgtaaggaactggaatcacccctctcttgcctttgctgtcctctgtgttccacgactgctcttcaggcttt

SEQ ID NO: 58 - DNA, 468 bp, Homo Sapiens
  allele 179: 12-223-179 : polymorphic base A or G
  misc_binding 159..178: 12-223-179.mis1, potential
  misc_binding 180..199: 12-223-179.mis2, potential complement
  primer_bind 1..20: upstream amplification primer
  primer_bind 449..468: downstream amplification primer, complement
  misc_binding 167..191: 12-223-179 potential probe
gagtaacggagaaataagagtcctcaacaaaatacaaagggttggcacacacattgcaggagccccaggcctgctctagggggaggcagatcaagaatcttaaggcactgtggttctgtggagaccaagacgtggcaagagaagacctggagctgtcaagctttggctttctgggcctractctgtggagttcagtcctcttccagtccctccttgggtaggggaactttagtatctagtgcttctgttacaaggtcctggggcccggaggtagtagttgagaagcagaagaagtggggcagggtgaggagaatgccactccctgaaagaaggaaggccccagccaccacaaaagaagccgtgtagttgcctgtcacatcccggaggtagcctaggtccaagagagaaaaagaatacacatgagtgatctatttgctggggctgaggcctcagatacatttttgggtg

SEQ ID NO: 59 - DNA, 468 bp, Homo Sapiens
  allele 207: 12-223-207 : polymorphic base C or T
  misc_binding 188..206: 12-223-207.mis1
  misc_binding 208..227: 12-223-207.mis2, potential complement
  primer_bind 1..20: upstream amplification primer
  primer_bind 449..468: downstream amplification primer, complement
  misc_binding 195..219: 12-223-207 potential probe
gagtaacggagaaataagagtcctcaacaaaatacaaagggttggcacacacattgcaggagccccaggcctgctctagggggaggcagatcaagaatcttaaggcactgtggttctgtggagaccaagacgtggcaagagaagacctggagctgtcaagctttggctttctgggcctgactctgtggagttcagtcctcttccagyccctccttgggtaggggaactttagtatctagtgcttctgttacaaggtcctggggcccggaggtagtagttgagaagcagaagaagtggggcagggtgaggagaatgccactccctgaaagaaggaaggccccagccaccacaaaagaagccgtgtagttgcctgtcacatcccggaggtagcctaggtccaagagagaaaaagaatacacatgagtgatctatttgctggggctgaggcctcagatacatttttgggtg

SEQ ID NO: 60 - DNA, 598 bp, Homo Sapiens
  allele 540: 12-225-541 : polymorphic base C or T
  misc_binding 521..539: 12-225-541.mis1
  misc_binding 541..560: 12-225-541.mis2, potential complement
  primer_bind 1..19: upstream amplification primer
  primer_bind 581..598: downstream amplification primer, complement
  misc_binding 528..552: 12-225-541 potential probe
catttccagccttatcttcatctcagcccagccatgccctaatcccaatactaaccccagcttctacattttctttttttttgagactgagtctcactgtgtcgtccaggctggagtgcaacggcacaacctcggctcactgccacctctgcctcctgggttcaagtgattctcctgcctcagcctcccaagtagctgggattacaggcgcacaccaccacacccagctaatttttgtatttttagtagagatggggtttcaccatgttggccaggccggtctcaaactcctgacctaaagtgatctgtctgcttcggtctcccaaagtgctgggatttataggcgtgagccaccgcacctgtcgccccccacccagctcctacttcaaccccaaccccagaatcaacttgaattttaacaccagcccaaagccaaaattgaacctcgactctattctgtttccaaattcaccaccaaagttaaccccaattccatccatggctccaacgtgcatactgaccccaatcctagcatgagayacaacctccagtcctgcctgattaactggcccactgggtagtcctagcaatgcgttta

SEQ ID NO: 61 - DNA, 508 bp, Homo Sapiens
  allele 166: 12-226-167 : polymorphic base G or C
  misc_binding 147..165: 12-226-167.mis1
  misc_binding 167..185: 12-226-167.mis2, complement
  primer_bind 1..19: upstream amplification primer
  primer_bind 490..508: downstream amplification primer, complement
  misc_binding 154..178: 12-226-167 potential probe
gtatctggaggtgtttttgcaagcagcagcaatactttttttgggagtgcgtcttgggtggggtttttaaagtctccctttcataaatctactttacagcattaatctgtgaggacttgcagtctccacctaacctcaaaaagtaacatgtaaaatcggtgacatsaagattccactgatgtgtgattcagaaatgtcacaccacccgctcatgccatggtgttatcaacattaaaaaatattctgtgatttattttataaaacaatagctttaaaaaataaactttaaattttagaatggttttagatttacaggaaaattgcaaagatagtacagagaatttatcaccaacgttttgaaatttgtttaaaaatgtttaggtttggggttctctttggggttatttgtggtgaccctgtactcttgtataacggctaagtaaaatatttcaagcagtagctggatctcagtctcctgtaatctgagtacactatatcaagaaactcc

SEQ ID NO: 62 - DNA, 508 bp, Homo Sapiens
  allele 455: 12-226-458 : polymorphic base C or T
  misc_binding 435..454: 12-226-458.mis1, potential
  misc_binding 456..475: 12-226-458.mis2, potential complement
  primer_bind 1..19: upstream amplification primer
  primer_bind 490..508: downstream amplification primer, complement
  misc_binding 443..467: 12-226-458 potential probe
gtatctggaggtgtttttgcaagcagcagcaatactttttttgggagtgcgtcttgggtggggtttttaaagtctccctttcataaatctactttacagcattaatctgtgaggacttgcagtctccacctaacctcaaaaagtaacatgtaaaatcggtgacatcaagattccactgatgtgtgattcagaaatgtcacaccacccgctcatgccatggtgttatcaacattaaaaaatattctgtgatttattttataaaacaatagctttaaaaaataaactttaaattttagaatggttttagatttacaggaaaattgcaaagatagtacagagaatttatcaccaacgttttgaaatttgtttaaaaatgtttaggtttggggttctctttggggttatttgtggtgaccctgtactcttgtataacggctaagtaaaatatttcaagyagtagctggatctcagtctcctgtaatctgagtacactatatcaagaaactcc

SEQ ID NO: 63 - DNA, 456 bp, Homo Sapiens
  allele 332: 12-229-332 : polymorphic base G or C
  misc_binding 312..331: 12-229-332.mis1, potential
  misc_binding 333..352: 12-229-332.mis2, potential complement
  primer_bind 1..21: upstream amplification primer
  primer_bind 437..456: downstream amplification primer, complement
  misc_binding 320..344: 12-229-332 potential probe
ctggttttggtcatttctgtgactccagtatggactgtggagatccccctctctgagggttcagggcctggcctctgtggtcctagtcttcaggggagttagggtcctcagtggcacagggacaggaagcaggaaaaacatgggttatttaggaaagtcttcaaaggaagaccataatttcacctgctttcacagatgagcgtgagcctatgaagggcctggctgcccccagctctccctgtgtccttctgccccttccccagctctgaccatgggacctcacatatctccattatcccccatctgtgtgtgtgtgtttggtggtccccacsggtgtgaggggcctgtgtgactgaggacttgtgctggtccctgaggtcaaaggcctgggcatcccccaccctgaaatccttcccatcccgccctttcctggtgtcctttatgctcagccctcct

SEQ ID NO: 64 - DNA, 456 bp, Homo Sapiens
  allele 351: 12-229-351 : polymorphic base G or C
  misc_binding 331..350: 12-229-351.mis1, potential
  misc_binding 352..371: 12-229-351.mis2, potential complement
  primer_bind 1..21: upstream amplification primer
  primer_bind 437..456: downstream amplification primer, complement
  misc_binding 339..363: 12-229-351 potential probe
ctggttttggtcatttctgtgactccagtatggactgtggagatccccctctctgagggttcagggcctggcctctgtggtcctagtcttcaggggagttagggtcctcagtggcacagggacaggaagcaggaaaaacatgggttatttaggaaagtcttcaaaggaagaccataatttcacctgctttcacagatgagcgtgagcctatgaagggcctggctgcccccagctctccctgtgtccttctgccccttccccagctctgaccatgggacctcacatatctccattatcccccatctgtgtgtgtgtgtttggtggtccccacgggtgtgaggggcctgtgtsactgaggacttgtgctggtccctgaggtcaaaggcctgggcatcccccaccctgaaatccttcccatcccgccctttcctggtgtcctttatgctcagccctcct

SEQ ID NO: 65 - DNA, 420 bp, Homo Sapiens
  allele 364: 12-230-364 : polymorphic base C or T
  misc_binding 344..363: 12-230-364.mis1, potential
  misc_binding 365..384: 12-230-364.mis2, potential complement
  primer_bind 1..20: upstream amplification primer
  primer_bind 401..420: downstream amplification primer, complement
  misc_binding 352..376: 12-230-364 potential probe
ttccgactcccaccatttccaggcatctataaaaagggggcaatgcttcaaaggattgttggtgagacttcagtgaagtaaagcttgggaaggacccagcacaactccaggcacagggcaggcgtcctacaaatgtaggttcccatccatttcattccatcccattttctagccaccggtagccaccctttcatctctacgccagtccaattctactccaagtcactatgcccctcctgtctggatttgtgaggggcagtcagaccagaaggggccagaaggtgatatttgtcatctccctgctgctataccaacctctcagctacctgagttttttgggtccctttgtctgccttcccagccycagcctgagacctgggcatctgacttgaaggatgcaggtcttagtggacatggtaa

SEQ ID NO: 66 - DNA, 490 bp, Homo Sapiens
  allele 99: 12-231-100 : polymorphic base C or T
  misc_binding 79..98: 12-231-100.mis1, potential
  misc_binding 100..119: 12-231-100.mis2, potential complement
  primer_bind 1..19: upstream amplification primer
  primer_bind 470..490: downstream amplification primer, complement
  misc_binding 87..111: 12-231-100 potential probe
agttgatgagatgcccgaggscccgctcacctctctgtaggcctgtgcaggtgtgatttccctccaggtgagaccatgacacccgtccctcacaaatgygttttaaaccagaatcggtctcattgcaagggactcctgattgtgaacggaggagagaaagataggatgaaagcttgagatggaggtagctaaagctgggtatggctctttgaatgggatagagggaaggaaccctaaagaagagatgctgcccagcatttaaaatgttttgacagtaggggagaggcaggagaaagctttgcagaggaaatggcatggagatgtgggcaggggcaaaggagattcatggccaacaagaggtacagaaaggaacgcactgggagggacaagatccacctgcacaaggacaggaagaggcttgtgtggcatccactgcagccagttgcagcctcttcagcgtctggcccttctatgactttgggactttctc

SEQ ID NO: 67 - DNA, 490 bp, Homo Sapiens
  allele 147: 12-231-148 : polymorphic base C or T
  misc_binding 127..146: 12-231-148.mis1, potential
  misc_binding 148..167: 12-231-148.mis2, potential complement
  primer_bind 1..19: upstream amplification primer
  primer_bind 470..490: downstream amplification primer, complement
  misc_binding 135..159: 12-231-148 potential probe
agttgatgagatgcccgaggscccgctcacctctctgtaggcctgtgcaggtgtgatttccctccaggtgagaccatgacacccgtccctcacaaatgcgttttaaaccagaatcggtctcattgcaagggactcctgattgtgaayggaggagagaaagataggatgaaagcttgagatggaggtagctaaagctgggtatggctctttgaatgggatagagggaaggaaccctaaagaagagatgctgcccagcatttaaaatgttttgacagtaggggagaggcaggagaaagctttgcagaggaaatggcatggagatgtgggcaggggcaaaggagattcatggccaacaagaggtacagaaaggaacgcactgggagggacaagatccacctgcacaaggacaggaagaggcttgtgtggcatccactgcagccagttgcagcctcttcagcgtctggcccttctatgactttgggactttctc

SEQ ID NO: 68 - DNA, 490 bp, Homo Sapiens
  allele 265: 12-231-266 : polymorphic base C or T
  misc_binding 245..264: 12-231-266.mis1, potential
  misc_binding 266..285: 12-231-266.mis2, potential complement
  primer_bind 1..19: upstream amplification primer
  primer_bind 470..490: downstream amplification primer, complement
  misc_binding 253..277: 12-231-266 potential probe
agttgatgagatgcccgaggscccgctcacctctctgtaggcctgtgcaggtgtgatttccctccaggtgagaccatgacacccgtccctcacaaatgcgttttaaaccagaatcggtctcattgcaagggactcctgattgtgaacggaggagagaaagataggatgaaagcttgagatggaggtagctaaagctgggtatggctctttgaatgggatagagggaaggaaccctaaagaagagatgctgcccagcatttaaaaygttttgacagtaggggagaggcaggagaaagctttgcagaggaaatggcatggagatgtgggcaggggcaaaggagattcatggccaacaagaggtacagaaaggaacgcactgggagggacaagatccacctgcacaaggacaggaagaggcttgtgtggcatccactgcagccagttgcagcctcttcagcgtctggcccttctatgactttgggactttctc

SEQ ID NO: 69 - DNA, 1000 bp, Homo Sapiens
  allele 500: 10-231-23 : polymorphic base A or G
  misc_binding 480..499: 10-231-23.mis1, potential
  misc_binding 501..519: 10-231-23.mis2, complement
  primer_bind 478..495: upstream amplification primer
  primer_bind 879..898: downstream amplification primer, complement
  misc_binding 488..512: 10-231-23 potential probe
  misc_feature 83,91..92,720,723: n=a, g, c or t
attaaatagttttttatttgattttaaataacagagtaagtgtagaagaaaaaaggaaagtatagagagtatttttccattanaaatattnnttatttaactgcttccaaattaaactggtgtcttcaaatgaacaaacatttctttaaaaatgtcattactaaagttcaaattcaacatgaatgtacttttataattcctaacgaatagctaaggtgaaaatatctttcttttttattgtgaatttgtatattgctgaccctactgagaaaacaatgacatgtggcttaattatgatataaacagtacaaaaataattttaagtttccgtaatttcaacatatttctcataaaatacttggcaaatgaaaagcaacacaagccctgtagtttcctaataattattcacagtataaatttgaacaagtaaatatggaaaataaacagtatcatccaaacatgtttaccttttctctaagtgatgtgtgataacccattcrtatacacagggaactcaacctatctagtgtccttgggtagactttttcttcctaagacgcatactcataattgtttaaatcttagaactgcatccaagaggaagcttaacaatagtgattgtttattttgtaggttttaaagacgctagagtgccaaagaagactttgaagtgtgaaaacatttcctgtaattgaaaccaaaatgtcatttatagatccnttnccagcacattatagtaagtcattcactgtttatgaattctttcttggagggggtctgatatgtttctgtgaatattgcgggtgttgctagtaaagtcaaactgtgacaacttctgcatttgttattaaactcatatgaacttaatataatacaaagaggctatggaacataataaaaataatttatctcttcattttattactgtaagtttccagaaaagaggaacttgaaaggaaaaaaatacccaaacaccataataataatggaacaataaaaa

SEQ ID NO: 70 - DNA, 1001 bp, Homo Sapiens
  allele 501: 10-233-386 : polymorphic base A or G
  misc_binding 481..500: 10-233-386.mis1, potential
  misc_binding 502..520: 10-233-386.mis2, complement
  primer_bind 119..137: upstream amplification primer
  primer_bind 540..557: downstream amplification primer, complement
  misc_binding 489..513: 10-233-386 potential probe
aataaacaattccctctcacaggactattatgaaggacagcgacatatgtaaaaagtatctaccctatgatgtttttctattatgtgtatattatcttgtctcagacatttaaatacatcactacagattcattgagaataaactgacaacatatattaataaaaaaattaggaactatgaatcacatttctacctccttcttgtttgtgtttactatctgtagttgatactccagatccctatgtggaactttttatctctacaacccctgacagcaggaagagaacaagacatttcaataatgacataaaccctgtgtggaatgagacctttgaatttattttggatcctaatcaggaaaatgttttggaggtaagtgaaccatttggatgctgttagatggttgtgattcatgttgagagacatgcttgagtttgtccttttactgcctttttgttcctgttagctatagttggagttagactgggcagcttggtagrctagaatctaaatggtgtctgtcaagtaatatgagtgtctatcaggacatacaggagttaggtagggttgggaaaactgctgtcctccccacgtgctttggagaaaacatattttctgctatcaaggagagaatcccagtataacagaataaaaatattttaaattgcctttttaaaaagtgaaaattaatttttcccaaaatatttgtatcgattttctgcattaatatctttctcatattccaaagtagagaggagataaagtttcgtttttgaaaacatgataattgaataaatcaatcaggaaaatgtgaaaaattattatcttatagcaaacacagtactcagaaggaaaagattggccgggcactgtggctcaccccacagcattttcagagcaccaaggcaggcagatcacttgaggtcaggagctcgagaccagcctggccaacacggtgagaccctgtctctattaaaaatacaaaaatttgctggatgtg

SEQ ID NO: 71 - DNA, 761 bp, Homo Sapiens
  allele 501: 10-238-328 : polymorphic base C or T
  misc_binding 482..500: 10-238-328.mis1
  misc_binding 502..521: 10-238-328.mis2, potential complement
  primer_bind 183..200: upstream amplification primer
  primer_bind 603..620: downstream amplification primer, complement
  misc_binding 489..513: 10-238-328 potential probe
gggcaccttctctcttggactgtggatgaaagttcagtgtttcctctgacacctctttttttctttaccttcatggtagactagctcctgtctgattgacacattcttttcttaaatgttttaatatctgcaatcagataatgaagttaaccaaatatgtccaccatgctttatttacagagtgtgccttctttctttggagactgttgtgtaatgctctttatctttactgattgtgttttgttttctgtataggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgatatctttgggatgttaataggagaaacactaattcataatgtaagttacagttcaatctacaytgcttttataacaagtagacagaacatattataatattatattttaaataaaagaaaatgtaatacattttataaaagtcagtggactctacttatttgtccaactatgcgtactgagcccattctccccaccagagattataattcttctacctttcaaactagtgcttactaattcatttcaatgatgtaaagattttgaatgtgtgaggaagtgcttttgtattccttttctctggaaaaaaaaaaaaaaaaaaaaa

SEQ ID NO: 72 - DNA, 651 bp, Homo Sapiens
  allele 501: 10-239-368 : polymorphic base C or T
  misc_binding 481..500: 10-239-368.mis1, potential
  misc_binding 502..521: 10-239-368.mis2, potential complement
  primer_bind 138..157: upstream amplification primer
  primer_bind 538..556: downstream amplification primer, complement
  misc_binding 489..513: 10-239-368 potential probe
cttaaatgttttaatatctgcaatcagataatgaagttaaccaaatatgtccaccatgctttatttacagagtgtgccttctttctttggagactgttgtgtaatgctctttatctttactgattgtgttttgttttctgtataggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgatatctttgggatgttaataggagaaacactaattcataatgtaagttacagttcaatctacactgcttttataacaagtagacagaacatattataatattatattttaaataaaagaaaatgtaatacattttataaaagtcagtggactctacttatttgtccaactatgygtactgagcccattctccccaccagagattataattcttctacctttcaaactagtgcttactaattcatttcaatgatgtaaagattttgaatgtgtgaggaagtgcttttgtattccttttctctggaaaaaaaaaaaaaaaaaaaaa

SEQ ID NO: 73 - DNA, 1001 bp, Homo Sapiens
  allele 501: 10-223-30 : polymorphic base G or C
  misc_binding 482..500: 10-223-30.mis1
  misc_binding 502..521: 10-223-30.mis2, potential complement
  primer_bind 472..490: upstream amplification primer
  primer_bind 900..917: downstream amplification primer, complement
  misc_binding 489..513: 10-223-30 potential probe
gccagcctgggtaaccatttaaaaaacataaagaagaaagataactagttattatgctagaatttactgctgtctttgttttaaggatttctggttgttattttagtttttataactgctctcttaatatgttctgcaggaagcacaaattcttgacaccaaaaggtgaatttcaactgacaattttcaatattattgaaagtcaaaagataatttatgttagtatctttcattcattttaagaaaactgtttggtagctcacctgtagattttggttttatcctttatcttcataaacaccacttaaaaatatctaataaagaaaaaggcatattttttggtataacaaggagcttcctataatcaagttgttatttttgtcagaattatgataaacataaaattatcctctttaagtcatgaattaataaatataaactaatttttcatgtcccaggaaattttgtttccagtgagaaatctgagaacatgattaaatstaataaatctagaattattaaatggatttaaatttatactagtagagctagtagatctcactctgtggttttgctcagattacttttttatattaaaattaattgttaattttgacacctgaaatgcttcaatttttttgttttcttttcacagaaaatattaccacaaagcatattgtgagtaatgatagctcggacagtgatgatgaatcacacgaacccaaaggtgagtgagccggaaacttttctggcccagatccatgaggaaaggatatgaacactctgtctgattttctcactcaagatgctgatggtaatcttcacttcagacacggaagtgataaaattgtagctttctgttgagagagaggattgcatgttgcatgtctaataaaataggcagcacatataaatccctaatttattttgttttaatacctcaaaaatactataagttgaacaaatgaacagatccaagatggtagaaatgctgaattcta

SEQ ID NO: 74 - DNA, 1001 bp, Homo Sapiens
  allele 501: 10-223-72 : polymorphic base A or G
  misc_binding 481..500: 10-223-72.mis1, potential
  misc_binding 502..521: 10-223-72.mis2, potential complement
  primer_bind 431..449: upstream amplification primer
  primer_bind 859..876: downstream amplification primer, complement
  misc_binding 489..513: 10-223-72 potential probe
taactagttattatgctagaatttactgctgtctttgttttaaggatttctggttgttattttagtttttataactgctctcttaatatgttctgcaggaagcacaaattcttgacaccaaaaggtgaatttcaactgacaattttcaatattattgaaagtcaaaagataatttatgttagtatctttcattcattttaagaaaactgtttggtagctcacctgtagattttggttttatcctttatcttcataaacaccacttaaaaatatctaataaagaaaaaggcatattttttggtataacaaggagcttcctataatcaagttgttatttttgtcagaattatgataaacataaaattatcctctttaagtcatgaattaataaatataaactaatttttcatgtcccaggaaattttgtttccagtgagaaatctgagaacatgattaaatctaataaatctagaattattaaatggatttaaatttatactrgtagagctagtagatctcactctgtggttttgctcagattacttttttatattaaaattaattgttaattttgacacctgaaatgcttcaatttttttgttttcttttcacagaaaatattaccacaaagcatattgtgagtaatgatagctcggacagtgatgatgaatcacacgaacccaaaggtgagtgagccggaaacttttctggcccagatccatgaggaaaggatatgaacactctgtctgattttctcactcaagatgctgatggtaatcttcacttcagacacggaagtgataaaattgtagctttctgttgagagagaggattgcatgttgcatgtctaataaaataggcagcacatataaatccctaatttattttgttttaatacctcaaaaatactataagttgaacaaatgaacagatccaagatggtagaaatgctgaattctattttaagtctgattagagcactaggcttctcagcatggtta

SEQ ID NO: 75 - DNA, 1001 bp, Homo Sapiens
  allele 501: 10-223-130 : polymorphic base A or T
  misc_binding 481..500: 10-223-130.mis1, potential
  misc_binding 502..521: 10-223-130.mis2, potential complement
  primer_bind 374..392: upstream amplification primer
  primer_bind 802..819: downstream amplification primer, complement
  misc_binding 489..513: 10-223-130 potential probe
tattttagtttttataactgctctcttaatatgttctgcaggaagcacaaattcttgacaccaaaaggtgaatttcaactgacaattttcaatattattgaaagtcaaaagataatttatgttagtatctttcattcattttaagaaaactgtttggtagctcacctgtagattttggttttatcctttatcttcataaacaccacttaaaaatatctaataaagaaaaaggcatattttttggtataacaaggagcttcctataatcaagttgttatttttgtcagaattatgataaacataaaattatcctctttaagtcatgaattaataaatataaactaatttttcatgtcccaggaaattttgtttccagtgagaaatctgagaacatgattaaatctaataaatctagaattattaaatggatttaaatttatactagtagagctagtagatctcactctgtggttttgctcagattacttttttatattaaawttaattgttaattttgacacctgaaatgcttcaatttttttgttttcttttcacagaaaatattaccacaaagcatattgtgagtaatgatagctcggacagtgatgatgaatcacacgaacccaaaggtgagtgagccggaaacttttctggcccagatccatgaggaaaggatatgaacactctgtctgattttctcactcaagatgctgatggtaatcttcacttcagacacggaagtgataaaattgtagctttctgttgagagagaggattgcatgttgcatgtctaataaaataggcagcacatataaatccctaatttattttgttttaatacctcaaaaatactataagttgaacaaatgaacagatccaagatggtagaaatgctgaattctattttaagtctgattagagcactaggcttctcagcatggttactgtgatttgggaacatttttagatggctttaaaaattaacattttgtctttcagaa

SEQ ID NO: 76 - DNA, 1001 bp, Homo Sapiens
  allele 501: 10-223-262 : polymorphic base A or G
  misc_binding 481..500: 10-223-262.mis1, potential
  misc_binding 502..521: 10-223-262.mis2, potential complement
  primer_bind 243..261: upstream amplification primer
  primer_bind 671..688: downstream amplification primer, complement
  misc_binding 489..513: 10-223-262 potential probe
tcattcattttaagaaaactgtttggtagctcacctgtagattttggttttatcctttatcttcataaacaccacttaaaaatatctaataaagaaaaaggcatattttttggtataacaaggagcttcctataatcaagttgttatttttgtcagaattatgataaacataaaattatcctctttaagtcatgaattaataaatataaactaatttttcatgtcccaggaaattttgtttccagtgagaaatctgagaacatgattaaatctaataaatctagaattattaaatggatttaaatttatactagtagagctagtagatctcactctgtggttttgctcagattacttttttatattaaaattaattgttaattttgacacctgaaatgcttcaatttttttgttttcttttcacagaaaatattaccacaaagcatattgtgagtaatgatagctcggacagtgatgatgaatcacacgaacccaaaggtragtgagccggaaacttttctggcccagatccatgaggaaaggatatgaacactctgtctgattttctcactcaagatgctgatggtaatcttcacttcagacacggaagtgataaaattgtagctttctgttgagagagaggattgcatgttgcatgtctaataaaataggcagcacatataaatccctaatttattttgttttaatacctcaaaaatactataagttgaacaaatgaacagatccaagatggtagaaatgctgaattctattttaagtctgattagagcactaggcttctcagcatggttactgtgatttgggaacatttttagatggctttaaaaattaacattttgtctttcagaattttgttattaagtaacatgaaaaattatattctcactccattcctgacccttatcccactggctacaccctccctcttgagaaaggattagtgatgaagtggggtaaaagtatcaagaacttgatacgta

SEQ ID NO: 77 - DNA, 1001 bp, Homo Sapiens
  allele 501: 10-223-392 : polymorphic base A or G
  misc_binding 481..500: 10-223-392.mis1, potential
  misc_binding 502..521: 10-223-392.mis2, potential complement
  primer_bind 113..131: upstream amplification primer
  primer_bind 541..558: downstream amplification primer, complement
  misc_binding 489..513: 10-223-392 potential probe
tataatcaagttgttatttttgtcagaattatgataaacataaaattatcctctttaagtcatgaattaataaatataaactaatttttcatgtcccaggaaattttgtttccagtgagaaatctgagaacatgattaaatctaataaatctagaattattaaatggatttaaatttatactagtagagctagtagatctcactctgtggttttgctcagattacttttttatattaaaattaattgttaattttgacacctgaaatgcttcaatttttttgttttcttttcacagaaaatattaccacaaagcatattgtgagtaatgatagctcggacagtgatgatgaatcacacgaacccaaaggtgagtgagccggaaacttttctggcccagatccatgaggaaaggatatgaacactctgtctgattttctcactcaagatgctgatggtaatcttcacttcagacacggaagtgataaaattgtagctttctrttgagagagaggattgcatgttgcatgtctaataaaataggcagcacatataaatccctaatttattttgttttaatacctcaaaaatactataagttgaacaaatgaacagatccaagatggtagaaatgctgaattctattttaagtctgattagagcactaggcttctcagcatggttactgtgatttgggaacatttttagatggctttaaaaattaacattttgtctttcagaattttgttattaagtaacatgaaaaattatattctcactccattcctgacccttatcccactggctacaccctccctcttgagaaaggattagtgatgaagtggggtaaaagtatcaagaacttgatacgtatattatttcatagtataaatgagcccttttacattttgacaaggtagtttgcagtttggtgtggattatgatagtcagtgatggacttggggcagagataaggtgaggatcagatttgcaacaaatatga

SEQ ID NO: 78 - DNA, 1001 bp, Homo Sapiens
  allele 501: 10-224-341 : polymorphic base C or T
  misc_binding 481..500: 10-224-341.mis1, potential
  misc_binding 502..521: 10-224-341.mis2, potential complement
  primer_bind 161..179: upstream amplification primer
  primer_bind 561..580: downstream amplification primer, complement
  misc_binding 489..513: 10-224-341 potential probe
  misc_feature 732: n=a, g, c or t
ttagtagagatggtgtttcaccttgttggccaggatggtctcaatctcttgacctcatgatccgcccgccttggcctcccaaagtgctaggattacaggcgtgagccaccgtgcccagcccaaagatccctttttaaacatgtattttggagtctgtatggtgaccttttatttttccctaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcaggtaagtgtacaaatataattagtgggagctaatgcaggagatctttattccttctctggagagaagcattttaatyattattaacacttactcatttattatcagttattacaacctgcatttaatgtgtgaagggcttcaaatgactagggttttttttttgttgttgtttgtttgtttgtatttttgagacagggtctcacccagtcacccaggctgcagtgcagtggcacaatcatggctcaccgcatccttaattcctgggctgcagcaatcctcctgcctcagcttcctgagtagctgggantacaggtgcacaccaccatacccagctaatttttgtagtttttgtagagacaggtttttgccgtgttgcccaagctggtctcagactcctgggctcaagtgatcctcctaccttagcctcccaaagtgctgggactgcaggtgtgagtcaccgtacctggcctggatttttttttaaagaaaaatttacattggagaggaaatggcctagacatgtcagtatagaaaattttcattaataatattgaggaggacggccggggagcagtg

SEQ ID NO: 79 - DNA, 1001 bp, Homo Sapiens
  allele 501: 10-227-282 : polymorphic base A or G
  misc_binding 481..500: 10-227-282.mis1, potential
  misc_binding 502..520: 10-227-282.mis2, complement
  primer_bind 220..238: upstream amplification primer
  primer_bind 620..638: downstream amplification primer, complement
  misc_binding 489..513: 10-227-282 potential probe
aattctctgaacccataattttttttctctagcagcttcttcaacataattttgctcagttcagtttatcaataatttttcaaatgcctgctgtggagctagccttgtgccaagaattaacataacaatagtgagtttgttttcaatttctttgaaattaatgaacttcctgagaacagggtcgtgattcatcctagcaaggagtacattgctggcacacagtagacacctagtgaacactgaattatggtcagaccaactgaatcaatgaaaactgaaaatttccaaattcatctttccatctttcccataggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacarggctccaggtaagtagggagtaagctgtattccataaaatagaaattaagtaggggacgaaactgacattaaactgtttcactctgtcactgctgtaccagctattacactattgaatgcttcccttaccttgataaatagatactattctgagacctcaagtacttctcctctttcttaccccaagatcccctgacttgctcacagttcagaaactgcaaagtcaacaaccagtttagcaaaaatctctgggactttacttcaatactttgaattatgtttgttctgattgatttttaatcaaatattttgactatcacccttgtaagaaagcccttatttcagaaaaatcatgcaaatttctgggaattttacgtgactacaagattaacgtaatctagcagtacacaatggctagcagtttcagtttgccatgttgtatttcacagaaaacaagaatcaagtttgaggcatagtcttttttgttttgttttattttt

SEQ ID NO: 80 - DNA, 1001 bp, Homo Sapiens
  allele 501: 10-240-241 : polymorphic base A or G
  misc_binding 481..500: 10-240-241.mis1, potential
  misc_binding 502..521: 10-240-241.mis2, potential complement
  primer_bind 261..279: upstream amplification primer
  primer_bind 595..614: downstream amplification primer, complement
  misc_binding 489..513: 10-240-241 potential probe
aaattaagtatgtccctaaagtcacagaataataagtgatggaggtggaattcaaatgtaatattttgtttgttggtttgtttagttttgaaggtaacatactttttagtctacaacctatttaactacaaaagtgtgccaatcactggtattaggattggggcagatgtatactctgaaaataaaagtgcaaaataaatatcccatctggaaataaaagtgcaaaataaagagggaggaaaaatcagcccttccatttcttttcctttgtaatgccagttgaattggtttagtgagtagttttgcaagacttgtttcactttgtttttggacatagctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataraggtaagtcttggttttccttttagttagttttggttgttttgaaaacttttctcatcactatgttaaatgttactgcttctacaggatttatggttagttgcatttaacatgataagtcattcataaatctttctgtagaattacattggatatttatattttaggaatcacaaattacaatatttttgttctacttagttaacaaatacaagtaaaaataagataagtttgcttaatactggctcattgtactcttggtaagttaccatgagaaagaagggaagaatgtgctttccctctggtagccttaaaagaatgtgtttttcctttccttccccttgaaatatttcttcccaagagctgtgtgttttacagagaaatcgtgatgggggctgctttttgggggcaagaacaaaagtgataggagtgggctgcagggaactgtttcaaaatagtaggactttcataatttattttcttcttttgtaaggaaaacaa

SEQ ID NO: 81 - DNA, 741 bp, Homo Sapiens
  allele 501: 10-249-185 : polymorphic base A or G
  misc_binding 481..500: 10-249-185.mis1, potential
  misc_binding 502..521: 10-249-185.mis2, potential complement
  primer_bind 317..335: upstream amplification primer
  primer_bind 720..738: downstream amplification primer, complement
  misc_binding 489..513: 10-249-185 potential probe
  misc_feature 65,171..173: n=a, g, c or t
agtagttttctaaagcaatgaaattagaaaactatataatttcagtatctgattatactgcttgnttatttgagaagtacaaacctcaaagattggaaacatgaatatattattttaaaagtaattttacttctgttttctgttagcacacagtcctctgtgttttgatcnnngtgatttctcccctgtgtataagattactaaccctatgctttaagaagttattgatgaattcagtaaattttattttaatccctctagatctggaagggtaagataatgtttcaaaatatttggtacactttgtatgtgaagggaagaagctctaaaagatggttgggtttagggatgagttgtacgatgacctaaagtcaggtaatatcacattttttaacctagcatgttacttattggaagtcctgattctaatctttttttttgtagcccctggatgaaacactgaagaaagcccttacaggtcaccttgaggaggttgttttrgctctgctaaaaactccagcgcaatttgatgctgatgaacttcgtgctgccatgaaggtaaatcgcccaatttgagcaaactcctttcctcaagaggatgtattgggcaagtcacttatgcttatgttattttcaaaatctagtatagtacctgtcaatcagtgggagtttgaagaataaataaattaatacctcaatgaaggaattaatatataaatgaaaacagaaatgttggcacta

SEQ ID NO: 82 - DNA, 1001 bp, Homo Sapiens
  allele 501: 10-251-128 : polymorphic base A or G
  misc_binding 481..500: 10-251-128.mis1, potential
  misc_binding 502..521: 10-251-128.mis2, potential complement
  primer_bind 374..393: upstream amplification primer
  primer_bind 732..751: downstream amplification primer, complement
  misc_binding 489..513: 10-251-128 potential probe
aggtaatttttaaagataaaaaggtttatttggctcaggattctgatggctaacaaattcaagtttgggtatctatgtctggtgagagcctcaggctgcttccactcctgacagaagaggaaagggagctggtgtgtgcagagaccacatggcaagaaaggaagcaagagagagaatggggaggtgccagcctcgttaacaaccagctctcgtggttctcatgagcaagaactcattcccagtgacggcattaatctcttcatgagagatcagccccaggacccaaatacctccctctaggccccacctttaacactggggatcaaatttcaacatgaggtttggaggggaagaacatctaaaaccatcgcaagtaaaatcttgtatctgagctccttctagaaatgagtaatagaatacctttttctcaaaaaatattatttatctgagtttaagataattaagtaaatcatgcaattacatgctagagaagagcttacratagaatgggatttctttcagggtgaccgatctgaggactttggtgtgaatgaagacttggctgattcagatgccagggtaaggaagtgcttacaaaatactgctgcagttcatcttcctaccttaagtggggctaccacatgatcccctgtgaaagcaaatctaagatcttctgagagaccaatggcttcttaatgttcatttcctgaatgaggcatgtctttctgtagcccccacacacaaaaaagtagtctttgtaagttttcaatatctctcattattcgtaaaaccagagagaactgaagaaggacaatacaaatttgatttgtcattcccaagaattgtttgttaaaaaaaactctgacctttcgttgtactaggtataagaaggggaaatgtaatttttttattatgtgcaatggaaagagtaagcatatttaacgttatttttaacagagaactttggaatggtttatagatgtcaatttatattgtcaaaa

SEQ ID NO: 83 - DNA, 903 bp, Homo Sapiens
  allele 501: 10-252-209 : polymorphic base A or G
  misc_binding 481..500: 10-252-209.mis1, potential
  misc_binding 502..521: 10-252-209.mis2, potential complement
  primer_bind 293..312: upstream amplification primer
  primer_bind 701..720: downstream amplification primer, complement
  misc_binding 489..513: 10-252-209 potential probe
gtaaggttgatctatttgtctaagattatgcagctttgaaattgcagagtcagaatttgaatacagaaattctaacatcaaaatgcaaggtccaggttacggttgaattattgatttataagtaacatttgctgataattactttgaacaacacagagtaaaaaatctttagagatccccttggagttgtcttactatagagcataatcttaaagcaatttagttcagcaaacatttattctgcaaacatatattcagactctagtgtttacaaggcaccttgagagaaactgtggaagatatttgacaaacaaaataaggtccctatctttaaagaacttgcaatcttattgttgactactctgattgtattgggcacaaagcgattgcctatataatctttgacaaggtctaacattattgtgcagatatcatttcagcagatagtgaagtgtttacttttgtgtttcttgacaggccttgtatgaagcaggagaaagragaaaggggacagacgtaaacgtgttcaataccatccttaccaccagaagctatccacaacttcgcagaggtaacaataaatttctttttctggaatctgtttatggaagatgcaattttcttttttgatgacaaataagagaaagtaaaaacagaaccctttttcaatatcactcctgtatcaaacagatacagtgttcctgacccattgttatttgtcaatttgtccaattttgtacagccgctactttatcatatttaatacattttgtgacttgggcatgtggaacataattttgttattttcactgcttttactcccctaaaagatttggaatatgtgtgggaaaagacatgcataacagaacaaatgaaattagaatgaagaaaaacaaaaaaaaa

SEQ ID NO: 84 - DNA, 1001 bp, Homo Sapiens
  allele 501: 12-387-32 : polymorphic base A or G
  misc_binding 482..500: 12-387-32.mis1
  misc_binding 502..521: 12-387-32.mis2, potential complement
  primer_bind 470..488: upstream amplification primer
  primer_bind 901..921: downstream amplification primer, complement
  misc_binding 489..513: 12-387-32 potential probe
  misc_feature 357,519,523: n=a, g, c or t
cctctctagtagtctgcagtgtctgttgttcatagggtgttctttttaaatgttcttatagtaacataaataaagtatttacataggcttgaacacctagtggcttctccactcccaaggagaatatatgttggatagcgcaaactactgaagttgctcttgagatgtatttaaggtaataaaaaaattgatcgtcagggaaaagaatattcaaaaccaccatctagagagtcacaaataccttctcagaagttaactgccctatattgggagatgagaggtgaagaatgatgatgagggatagaacactgttggcaaaattctatatttcctgtttctttcatatggatatttcantttttttcatggtaaatacatcaactaaaattttcttctctaacagtgaagtgcgccacaagcaaaccagctttctttgcagagaagcttcatcaagccatgaaagtatgtaccattctacttatatgtcctgcttagaggaaraattatttgtagaaagancagnaaacctcatgttgtttgaaaatctcacatttaatatcttcccattaatgagaatcattgttctatttgatgaaagaggtaatacactaccttctcagaataaacttctgttagattcggtgcttttttttacagatgagattgtaaagtgagcctgtaagtgatttacggctcacttgtgatttgcttaaaacatgtgtcaccacgggaagggtgatgtactttcttttttaacgtgtaattttagtggcctacttcctctaaggttgtgagttttataatctcccactttatgagtctgatttgttgtttttattattctgtcttttatgccacagattaatagttgaaacttttgaaatgtcattctatgattaaggatgtagaatgatgtatttgagatcaactatgtcactttaactttactgtctgacatgcatggtattatacaaggtacctcttctattctgacattttga

SEQ ID NO: 85 - DNA, 1000 bp, Homo Sapiens
  allele 500: 10-242-316 : polymorphic base G or C
  misc_binding 480..499: 10-242-316.mis1, potential
  misc_binding 501..520: 10-242-316.mis2, potential complement
  primer_bind 185..203: upstream amplification primer
  primer_bind 590..609: downstream amplification primer, complement
  misc_binding 488..512: 10-242-316 potential probe
  misc_feature 311,473,477: n=a, g, c or t
taaatgttcttatagtaacataaataaagtatttacataggcttgaacacctagtggcttctccactcccaaggagaatatatgttggatagcgcaaactactgaagttgctcttgagatgtatttaaggtaataaaaaaattgatcgtcagggaaaagaatattcaaaaccaccatctagagagtcacaaataccttctcagaagttaactgccctatattgggagatgagaggtgaagaatgatgatgagggatagaacactgttggcaaaattctatatttcctgtttctttcatatggatatttcantttttttcatggtaaatacatcaactaaaattttcttctctaacagtgaagtgcgccacaagcaaaccagctttctttgcagagaagcttcatcaagccatgaaagtatgtaccattctacttatatgtcctgcttagaggaagaattatttgtagaaagancagnaaacctcatgttgtttgaaaatstcacatttaatatcttcccattaatgagaatcattgttctatttgatgaaagaggtaatacactaccttctcagaataaacttctgttagattcggtgcttttttttacagatgagattgtaaagtgagcctgtaagtgatttacggctcacttgtgatttgcttaaaacatgtgtcaccacgggaagggtgatgtactttcttttttaacgtgtaattttagtggcctacttcctctaaggttgtgagttttataatctcccactttatgagtctgatttgttgtttttattattctgtcttttatgccacagattaatagttgaaacttttgaaatgtcattctatgattaaggatgtagaatgatgtatttgagatcaactatgtcactttaactttactgtctgacatgcatggtattatacaaggtacctcttctattctgacattttgagcccacaaatgaatagttatgaagttatcttccttttttctttgc

SEQ ID NO: 86 - DNA, 1001 bp, Homo Sapiens
  allele 501: 10-245-412 : polymorphic base A or G
  misc_binding 481..500: 10-245-412.mis1, potential
  misc_binding 502..521: 10-245-412.mis2, potential complement
  primer_bind 90..107: upstream amplification primer
  primer_bind 509..528: downstream amplification primer, complement
  misc_binding 489..513: 10-245-412 potential probe
  misc_feature 544,852,855..857,865: n=a, g, c or t
tatacctttttttgaatcaacaggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaattggtgtgtcattgactcttctattttgattttcttttctgtgtaattcagtggtttaatttgacattaagggatacaagcctgaattctagattataattatttaatgaaatagagttcacattctgaattgargaaaatacttatagcttttgaaaagggatactacattttatcngtatgtgtacagactattgagattgtgtctctgtataataaatttattgcactagcattataacaatttgatatattctatatttcattaactagtataaagatgaaatggcaatacttgtaaaaagttctcatgtttgtttcatggtaattttaggtttactttttctaagaaactgccaaattgttttccagagtggtaatactattccactttaccaccataaatctaacagtggttcagtttctccacatccttgccagcatttgaagttgtcactattttgtatttttagcattgcttattanttnnntatttatntatttaatttatttatttattttgagacagagccttgctttgttgcccaggctggagtgcattggcgtgatctcggctcactgcaacctccacctcccaggttcaagtgattctcctgcctcagcctcccgagtag

SEQ ID NO: 87 - DNA, 731 bp, Homo Sapiens
  allele 501: 12-378-171 : polymorphic base T or C
  misc_binding 481..500: 12-378-171.mis1, potential
  misc_binding 502..521: 12-378-171.mis2, potential complement
  primer_bind 652..671: upstream amplification primer, complement
  primer_bind 83..103: downstream amplification primer
  misc_binding 489..513: 12-378-171 potential probe
  misc_feature 592: n=a, g, c or t
tcagagggaataggcagttagctagagctaagcatagattagcagagacagaaacgctgagctgtcaaatacttcaaaaccagtagcagcaaacaaaatatccaagtgctgctctaaacttataagactattacaaacctaggaattttcaacacccaaagcaacataagtcttaaaggtatcttttggaatatgaaaaaccagagtcatgctataaagtgataataataagatatttctttcttatttatagttctttaacacttgcttttaaatatagtattcttttaaacacattatcccttgctataatacaagaaaaatgacagatgaatacttacaacttctcacattactcacatgtgagaatttttttcttgtttgtatggcctggagtagtgagtgtggaagggaaaagtaatacctgtcagctgaaatccaccagattgattttcactgctcagagccgggaattatttgtaacaaaggaagggtagcagygcaaagacaagagagagggaaaagactgggctgggttgaaggaagagatttggaaagattttagaaattgaggaatgggattggtactaancctgccatcttatgatgattgggtttttatttgtatgaatggaagtcttcttttggagaggattcagtaaaggttaaagaatctctctctctctccccccccattaagaggtagttttctgaaagtaaaaaaaaaaata

SEQ ID NO: 88 - DNA, 788 bp, Homo Sapiens
  allele 501: 12-378-228 : polymorphic base G or A
  misc_binding 481..500: 12-378-228.mis1, potential
  misc_binding 502..521: 12-378-228.mis2, potential complement
  primer_bind 709..728: upstream amplification primer, complement
  primer_bind 140..160: downstream amplification primer
  misc_binding 489..513: 12-378-228 potential probe
  misc_feature 649: n=a, g, c or t
atatatgaagtcaggtttatgactaagaaagccactgtttctctttcatgcaatgaatcagagggaataggcagttagctagagctaagcatagattagcagagacagaaacgctgagctgtcaaatacttcaaaaccagtagcagcaaacaaaatatccaagtgctgctctaaacttataagactattacaaacctaggaattttcaacacccaaagcaacataagtcttaaaggtatcttttggaatatgaaaaaccagagtcatgctataaagtgataataataagatatttctttcttatttatagttctttaacacttgcttttaaatatagtattcttttaaacacattatcccttgctataatacaagaaaaatgacagatgaatacttacaacttctcacattactcacatgtgagaatttttttcttgtttgtatggcctggagtagtgagtgtggaagggaaaagtaatacctgtcagctgaaatccaccrgattgattttcactgctcagagccgggaattatttgtaacaaaggaagggtagcagtgcaaagacaagagagagggaaaagactgggctgggttgaaggaagagatttggaaagattttagaaattgaggaatgggattggtactaancctgccatcttatgatgattgggtttttatttgtatgaatggaagtcttcttttggagaggattcagtaaaggttaaagaatctctctctctctccccccccattaagaggtagttttctgaaagtaaaaaaaaaaata

SEQ ID NO: 89 - DNA, 1001 bp, Homo Sapiens
  allele 501: 12-378-450 : polymorphic base T or A
  misc_binding 481..500: 12-378-450.mis1, potential
  misc_binding 502..521: 12-378-450.mis2, potential complement
  primer_bind 930..949: upstream amplification primer, complement
  primer_bind 361..381: downstream amplification primer
  misc_binding 489..513: 12-378-450 potential probe
  misc_feature 870: n=a, g, c or t
tagatattcctagcagaaacaaggctctaaaacgattttaataggcctgcagattttagtttaaatagaactagtacatggtttgaaaatacttaaaggaagataaatatccttgcctctgtgagggccaaacctcatgactgggaaaagtgcagtcagagaaaccatgaattacatttataattttgctgtgaatcttgaatcccttagtttcagtcaagatatatgaagtcaggtttatgactaagaaagccactgtttctctttcatgcaatgaatcagagggaataggcagttagctagagctaagcatagattagcagagacagaaacgctgagctgtcaaatacttcaaaaccagtagcagcaaacaaaatatccaagtgctgctctaaacttataagactattacaaacctaggaattttcaacacccaaagcaacataagtcttaaaggtatcttttggaatatgaaaaaccagagtcatgctataaagtgawaataataagatatttctttcttatttatagttctttaacacttgcttttaaatatagtattcttttaaacacattatcccttgctataatacaagaaaaatgacagatgaatacttacaacttctcacattactcacatgtgagaatttttttcttgtttgtatggcctggagtagtgagtgtggaagggaaaagtaatacctgtcagctgaaatccaccagattgattttcactgctcagagccgggaattatttgtaacaaaggaagggtagcagtgcaaagacaagagagagggaaaagactgggctgggttgaaggaagagatttggaaagattttagaaattgaggaatgggattggtactaancctgccatcttatgatgattgggtttttatttgtatgaatggaagtcttcttttggagaggattcagtaaaggttaaagaatctctctctctctccccccccattaagaggtagttttctgaaagtaaaaa

SEQ ID NO: 90 - DNA, 1001 bp, Homo Sapiens
  allele 501: 12-379-65 : polymorphic base A or G
  misc_binding 481..500: 12-379-65.mis1, potential
  misc_binding 502..521: 12-379-65.mis2, potential complement
  primer_bind 437..456: upstream amplification primer
  primer_bind 885..905: downstream amplification primer, complement
  misc_binding 489..513: 12-379-65 potential probe
  misc_feature 191..192,208,211,270,298,327,480,706: n=a, g, c or t
aaataagacgtgaatttcaaccaatagtgtcaacaattatttaaatacattttagacacagaatggcagagtatttagaagtgtattgaatttgattactttctaaaacgtgtgagatcagagtaagtcttaatatctatccagttgacttaattcatgctttaatatttttctgcttggtttgttttgannatagaaaaaagcattntgnattacattttctgtaatcaatataacttacatctggcaattttctaaggagtgtaaatntgtttgaaatacaaaataagttgcctanagaatcagcttatttatttttccaaagtncttttaaaaaattggaatctaagcatttatttatagtcaatgacttctagtgaatagaggctaagaaataatgaaaaaaaggtttaaacataagaactgaaggataaaagctaattcaagaactgaaagaatttcagagactatattaaaganaattatgaaaaagagttcaaraataatcaaccctgagaaaagatcataaatggacaaaaaccaggcacacacaatgcctttgcattgcattcatttcattataaagacaatgagtaagttgaactgtctcattatttcatcacttagctttgtctcaactgtcaggtatgaaaaattactgagaagaataaaagttttgaaaaggaaaaaaatttgaaaagtatgnaacacactatgagtgctaactccagaatagctggtttttcaagaattatacaggaaactgagtaatgatgtagtagttagaagcaaaagtgtagttctgaggttctcacacactcccaaaatggagaaacaaaggggatacttgtagttctatgggattatacatataggagttcatgggtgatttttcagcactaaaatgtagctgtatatgggttcatagacactgaagtcctcatattttggcctctatttgattttattataaatccaaaattttgccttccaggtagaat

SEQ ID NO: 91 - DNA, 1001 bp, Homo Sapiens
  allele 501: 12-382-204 : polymorphic base A or G
  misc_binding 482..500: 12-382-204.mis1
  misc_binding 502..521: 12-382-204.mis2, potential complement
  primer_bind 298..318: upstream amplification primer
  primer_bind 727..747: downstream amplification primer, complement
  misc_binding 489..513: 12-382-204 potential probe
gaggccctccaacagctattccacttgattgttgcatgagctaatggccataaaactccttagaaaagcacaaagcaaaactaaagaagagtatttactagtgttggatatatttgtaaaagtgagattacaaatcatgtatctggctatttttttcttaaacatgttccttcaagaatttttctgttcgttcattttaaatatttattaaatgttctgatttcttatgttcactgctagctaattaacaaggatggaatttttcttgccttggttatatctaaaagattgtaaaaactttgagaaagcaatgttgccctctttccacaggagtattttggtagctgtaagagaatgcacattgcaaatgactcaaatgtggtaaaatgttggtttcataattctgaaatggcctcttccccaaaagtgacagtaacaccctagctccaggctcaaccacatccagcacatagccaacatttaacagatgttgacaaaatrgttaataataatattattaaggaaccagccagagtttcatgcttattaaatactttttcaaccagaaggtctgcaaaggttgatttctgaatatgacgttagctctctctagacctattaatttacgacatttcaaatcagaggtaaaccagcagacctattatttttcaatgataaactataaacagttttttgaagtcaactatttccttttcctttaaaattggacagaatttcatcaggaagctcagaacaatccaatttatataatgccttccttcattatgctaattttcttcatcttcatctacttgaagtaatatttaagattggcacttcagagctgtaaatggatcttagatgataattacttcaacattcttattttataaacgaagaccctctggagaagctaaatgtttttcttgaggtcagatcgccagataatcaagaaccagtatacttcaatttgtattttatatcctatagttgtgggtaga

SEQ ID NO: 92 - DNA, 1001 bp, Homo Sapiens
  allele 501: 12-383-117 : polymorphic base A or G
  misc_binding 481..500: 12-383-117.mis1, potential
  misc_binding 502..521: 12-383-117.mis2, potential complement
  primer_bind 385..404: upstream amplification primer
  primer_bind 832..852: downstream amplification primer, complement
  misc_binding 489..513: 12-383-117 potential probe
  misc_feature 89: n=a, g, c or t
tctacatattacatgattccaactatataaatactgaaaatattgaaaaagacaaaacttatggagacagtaaaaagatcaatgatttncaggggttaggttgaaggggggagggataaataggtggagcacagaacagttttagggcaatgaaactattctgtatgatactataatggtagatacatggcagttacacatttccaagaacctgtagaactgtataatacaaagagtgaatcttatgtaaactatggatattggttaataatatatcaagggaaaaataagggagaggtagaaagggtgtatggagactctaatttccgtgcaatttttctgtaaacctaaaactgctctataaaaataaagtctattaaaatagctatctaattgtaaagctcataatatagccagggagaaaaaagctatgcaaaatatgatggtataatgtattaaaggtaatatataggcacataggaagcgctttggtaaatcaaragagagtaatggattcaggaaaggctacaaaacagcaaaaacctgaatggctggtggcatttcatattcctgaatgaattaattatcttttgtattgagaattaagacctaacaactataattagatgcatttttacaaaaatattattcggttttcaaataaacctgggagggaggtgttatctgctttctacaaatgaagaaatcaaagtttccagatttctctggacttgtccaagttcatacagtaggtcaatgaataaacacaaatttgaacacaggctttctgactatggatccatttcactaaagttacaggaagaaaattatgagaagaaagaccatagatatgaggaaaaaatgaaactaaatgagaacctgcttcagatgccaggtcttgttgcaagatactattataaaataagttggttttgtcatggagtagtggaaactctgtacaatcagtgaggaatctcttaaacacaatggtaataatattt

SEQ ID NO: 93 - DNA, 1001 bp, Homo Sapiens
  allele 501: 12-383-170 : polymorphic base A or G
  misc_binding 481..500: 12-383-170.mis1, potential
  misc_binding 502..521: 12-383-170.mis2, potential complement
  primer_bind 332..351: upstream amplification primer
  primer_bind 779..799: downstream amplification primer, complement
  misc_binding 489..513: 12-383-170 potential probe
  misc_feature 36: n=a, g, c or t
aaaacttatggagacagtaaaaagatcaatgatttncaggggttaggttgaaggggggagggataaataggtggagcacagaacagttttagggcaatgaaactattctgtatgatactataatggtagatacatggcagttacacatttccaagaacctgtagaactgtataatacaaagagtgaatcttatgtaaactatggatattggttaataatatatcaagggaaaaataagggagaggtagaaagggtgtatggagactctaatttccgtgcaatttttctgtaaacctaaaactgctctataaaaataaagtctattaaaatagctatctaattgtaaagctcataatatagccagggagaaaaaagctatgcaaaatatgatggtataatgtattaaaggtaatatataggcacataggaagcgctttggtaaatcaagagagagtaatggattcaggaaaggctacaaaacagcaaaaacctgaatggctrgtggcatttcatattcctgaatgaattaattatcttttgtattgagaattaagacctaacaactataattagatgcatttttacaaaaatattattcggttttcaaataaacctgggagggaggtgttatctgctttctacaaatgaagaaatcaaagtttccagatttctctggacttgtccaagttcatacagtaggtcaatgaataaacacaaatttgaacacaggctttctgactatggatccatttcactaaagttacaggaagaaaattatgagaagaaagaccatagatatgaggaaaaaatgaaactaaatgagaacctgcttcagatgccaggtcttgttgcaagatactattataaaataagttggttttgtcatggagtagtggaaactctgtacaatcagtgaggaatctcttaaacacaatggtaataatattttcaaatatataaaaatctaggaagtatatataataataagtacatttttaccc

SEQ ID NO: 94 - DNA, 1001 bp, Homo Sapiens
  allele 501: 12-383-268 : polymorphic base G or T
  misc_binding 481..500: 12-383-268.mis1, potential
  misc_binding 502..521: 12-383-268.mis2, potential complement
  primer_bind 234..253: upstream amplification primer
  primer_bind 681..701: downstream amplification primer, complement
  misc_binding 489..513: 12-383-268 potential probe
  misc_feature 914,917: n=a, g, c or t
gaaactattctgtatgatactataatggtagatacatggcagttacacatttccaagaacctgtagaactgtataatacaaagagtgaatcttatgtaaactatggatattggttaataatatatcaagggaaaaataagggagaggtagaaagggtgtatggagactctaatttccgtgcaatttttctgtaaacctaaaactgctctataaaaataaagtctattaaaatagctatctaattgtaaagctcataatatagccagggagaaaaaagctatgcaaaatatgatggtataatgtattaaaggtaatatataggcacataggaagcgctttggtaaatcaagagagagtaatggattcaggaaaggctacaaaacagcaaaaacctgaatggctggtggcatttcatattcctgaatgaattaattatcttttgtattgagaattaagacctaacaactataattagatgcatttttacaaaaatattattckgttttcaaataaacctgggagggaggtgttatctgctttctacaaatgaagaaatcaaagtttccagatttctctggacttgtccaagttcatacagtaggtcaatgaataaacacaaatttgaacacaggctttctgactatggatccatttcactaaagttacaggaagaaaattatgagaagaaagaccatagatatgaggaaaaaatgaaactaaatgagaacctgcttcagatgccaggtcttgttgcaagatactattataaaataagttggttttgtcatggagtagtggaaactctgtacaatcagtgaggaatctcttaaacacaatggtaataatattttcaaatatataaaaatctaggaagtatatataataataagtacatttttacccaaaaagtaaanaantagaaatattgtcttttgcttacagatatagtgattttttttttttggcaaatctaataaacaaggccatgaaatgcaattgta

SEQ ID NO: 95 - DNA, 1001 bp, Homo Sapiens
  allele 501: 12-384-336 : polymorphic base T or C
  misc_binding 481..500: 12-384-336.mis1, potential
  misc_binding 502..521: 12-384-336.mis2, potential complement
  primer_bind 816..836: upstream amplification primer, complement
  primer_bind 347..367: downstream amplification primer
  misc_binding 489..513: 12-384-336 potential probe
  misc_feature 87,120,417,714..715: n=a, g, c or t
tgcctgagctctttactctctctttgccttcctttccctccctgcccaacatttgctcttttctgttctgctctgatatgtgacttntgaagactttatcatgcaggttctcttgccttntgatttctgcctgaattcagcttatggaagaacctggcaggagctgggagatgaggcggaggtactcctgctccctccctgattctagagacttattaacatttgtgttcttctacagtcacaacttccatcaggtgtcaccttgtctgaggctctagctctcaactatttcctctccttgccctttggacttgggattcctgctgctgctgctccgtagatactgcaatatctcatgtgggttctcttaacttgcctacacctctaaggaagtacacctcagtattcccataattnaaaacaatcgtcaaatgtccagcttgttatactagccatttccttctagggccctgtctgatataccttccgaaagtgctgaayttacttactttatcaaaactacttggaaggctcctgaataaattctagacaaggtgacaggtaagtggatacacaaatgaataggagagccacctcagtaagtagtagtaaaaagcaaaattttagaaaacaaaaatatatagctttccataatccatggaaaaaatggtaaggtgaatttcactaaaattaaaaacttcttctttgcaaatnncactattatgagactaaaaagataaactacagacttggagaaaatttttgcaagacaaatatctgttagagaactgataaacaaaaatataaaaaaacctctaaagtctgaacagtaaaagaagttaaaaaattttaaaaaataagcgaaagatctgaacaggtacctcactaaagaagatataaagatggtaaataagcatatgaaaatatgctcaacatcatatatcattagggaattgcaaattaaaacaatgagacaccgctacactcctattagaataact

SEQ ID NO: 96 - DNA, 1001 bp, Homo Sapiens
  allele 501: 12-384-451 : polymorphic base C or G
  misc_binding 481..500: 12-384-451.mis1, potential
  misc_binding 502..521: 12-384-451.mis2, potential complement
  primer_bind 932..952: upstream amplification primer, complement
  primer_bind 463..483: downstream amplification primer
  misc_binding 489..513: 12-384-451 potential probe
  misc_feature 203,236,533,830..831: n=a, g, c or t
gtgctgggattacaggcatgagccacctggccaaaatttttgccagtcagtaagagagctaccttgttcagattgcatccccacatcttcctacttccaattaattttaaagaaactgcctgagctctttactctctctttgccttcctttccctccctgcccaacatttgctcttttctgttctgctctgatatgtgacttntgaagactttatcatgcaggttctcttgccttntgatttctgcctgaattcagcttatggaagaacctggcaggagctgggagatgaggcggaggtactcctgctccctccctgattctagagacttattaacatttgtgttcttctacagtcacaacttccatcaggtgtcaccttgtctgaggctctagctctcaactatttcctctccttgccctttggacttgggattcctgctgctgctgctccgtagatactgcaatatctcatgtgggttctcttaacttgcctacacctstaaggaagtacacctcagtattcccataattnaaaacaatcgtcaaatgtccagcttgttatactagccatttccttctagggccctgtctgatataccttccgaaagtgctgaacttacttactttatcaaaactacttggaaggctcctgaataaattctagacaaggtgacaggtaagtggatacacaaatgaataggagagccacctcagtaagtagtagtaaaaagcaaaattttagaaaacaaaaatatatagctttccataatccatggaaaaaatggtaaggtgaatttcactaaaattaaaaacttcttctttgcaaatnncactattatgagactaaaaagataaactacagacttggagaaaatttttgcaagacaaatatctgttagagaactgataaacaaaaatataaaaaaacctctaaagtctgaacagtaaaagaagttaaaaaattttaaaaaataagcgaaagatctgaacaggtacctca

SEQ ID NO: 97 - DNA, 757 bp, Homo Sapiens
  allele 258: 12-385-123 : polymorphic base C or T
  misc_binding 238..257: 12-385-123.mis1, potential
  misc_binding 259..278: 12-385-123.mis2, potential complement
  primer_bind 136..155: upstream amplification primer
  primer_bind 591..611: downstream amplification primer, complement
  misc_binding 246..270: 12-385-123 potential probe
  misc_feature 279,613: n=a, g, c or t
taagatgatacatttgtgttgttttaagccactaaatgtgtggtaatttgttagagttgcaatgaaaaaaatacaaattttccgtccccaaaatttgaaaaccaactccagagaaaaataacattgctgtttagtcaagtgaatggttgattttgtaattgtgcaagaagtattttaaattgaaattataattaaggagtatcatttctcatactgactggggtaagattatggagacatagtcgagccgaattcccycaggcctaaccttctaattcnttccctcatggttctcttgcatagctcctatgtcttaaacatggggctggctcagagcgtgaagtttcataagtgagtcctggctaagttctttgtctctttttccagtagcccaaatatcaatgttgacaccttaaaaggtacacaattttataaattatagacaattccctgtttcagactcttttttaaaatataaatacatgattcgaacatttttttctgcatacaagaaaaaaagttggaataatgcatgacattcatattaaacattattcatcagcactgaatgagaattgcaaaggctgagagacaaccagcatttatctatccncatatgttcaaaacgatcatctttaacatctatgtgatatctctcacatatgtcgaaactttaaagacagttgctgcaaaagttttgaaatatttcctttacaccactgagaataaaaatatcagaaggaagaggagaaatata

SEQ ID NO: 98 - DNA, 1001 bp, Homo Sapiens
  allele 501: 12-385-427 : polymorphic base G or T
  misc_binding 481..500: 12-385-427.mis1, potential
  misc_binding 502..521: 12-385-427.mis2, potential complement
  primer_bind 75..94: upstream amplification primer
  primer_bind 530..550: downstream amplification primer, complement
  misc_binding 489..513: 12-385-427 potential probe
  misc_feature 218,552,710,712,848,856..860: n=a, g, c or t
atgaaaaaaatacaaattttccgtccccaaaatttgaaaaccaactccagagaaaaataacattgctgtttagtcaagtgaatggttgattttgtaattgtgcaagaagtattttaaattgaaattataattaaggagtatcatttctcatactgactggggtaagattatggagacatagtcgagccgaattcccccaggcctaaccttctaattcnttccctcatggttctcttgcatagctcctatgtcttaaacatggggctggctcagagcgtgaagtttcataagtgagtcctggctaagttctttgtctctttttccagtagcccaaatatcaatgttgacaccttaaaaggtacacaattttataaattatagacaattccctgtttcagactcttttttaaaatataaatacatgattcgaacatttttttctgcatacaagaaaaaaagttggaataatgcatgacattcatattaaacattattcatcakcactgaatgagaattgcaaaggctgagagacaaccagcatttatctatccncatatgttcaaaacgatcatctttaacatctatgtgatatctctcacatatgtcgaaactttaaagacagttgctgcaaaagttttgaaatatttcctttacaccactgagaataaaaatatcagaaggaagaggagaaatatatagataatacagcnantaataaagtttagtatgaaaagagagttgtttattttctagtactggttataattatctctgaggttctatttagtattttgtatataattacctttctagtaggttgggtgcaaaataattagtgtttttttgtntttgtttnnnnntgagatggagtttcactcttgttgcccaggctggagtgcaatggcacaatctcggctgactacaacctcttcctcccaggttcaagcaattctcctgcctcagcctcccaggtagctgggattacaggcacacgcctccac

SEQ ID NO: 99 - DNA, 943 bp, Homo Sapiens
  allele 443: 12-386-155 : polymorphic base G or T
  misc_binding 423..442: 12-386-155.mis1, potential
  misc_binding 444..462: 12-386-155.mis2, complement
  primer_bind 290..310: upstream amplification primer
  primer_bind 669..688: downstream amplification primer, complement
  misc_binding 431..455: 12-386-155 potential probe
gtcagttgccttgattttgctaaagctttctaaagaaaaggatgttttgcatgtatcttagtttgaatttaatattcagtgtttcagaaatacaccaagtacagtaagcatgacatgaacaaagttctggacctggagttgaaaggtgacattgagaaatgcctcacagctatcggtatgtagtccagcagttgaaagagttttctaactagaaattgtattttcaaagctatcctatacttaacaagaacaacagcaacaaaaccaataaaagaaaacaaaaaacaatcagaagtagtgcatctgtttcaattgaagcaacgtaaaagattggcaaagtactataaccttaataacaatagatattattccccttttcaaaaatagagagagatagactatacttattgagcacctacttatatcaaacaatgtaccaggckgggcacaccacagaggcaattcagaatggtcactgagagcatgggatctggaataaatgtaacatctggataaatgtaacttcaagtcctggtctactgcttgttaattgtacaatcttgggcaggtccaggagagtctgattcagtgggtccgagttggcctctaaaaatcggtactttttaaagatctcccaggttattcagacaaccatcagggttggggaacctatgttctcaagcagtgtttctcattcatgactatgcacttgaatcccctggaaagcttgttaaaatgcagattctgattccccaggtctggggtggagcttagattctgcttttctaacaagctccccattgatgccaatgctgttggtccatagatctcgacaagatgaagaacactatgaactggaatgtgctagtattatttgggttctgttttatatttaagcccatcctatcccagagttttttcttcatttattcatttattttta

SEQ ID NO: 100 - DNA, 813 bp, Homo Sapiens
  allele 313: 12-386-24 : polymorphic base C or T
  misc_binding 293..312: 12-386-24.mis1, potential
  misc_binding 314..333: 12-386-24.mis2, potential complement
  primer_bind 290..310: upstream amplification primer
  primer_bind 669..688: downstream amplification primer, complement
  misc_binding 301..325: 12-386-24 potential probe
gtcagttgccttgattttgctaaagctttctaaagaaaaggatgttttgcatgtatcttagtttgaatttaatattcagtgtttcagaaatacaccaagtacagtaagcatgacatgaacaaagttctggacctggagttgaaaggtgacattgagaaatgcctcacagctatcggtatgtagtccagcagttgaaagagttttctaactagaaattgtattttcaaagctatcctatacttaacaagaacaacagcaacaaaaccaataaaagaaaacaaaaaacaatcagaagtagtgcatctgtttcaaytgaagcaacgtaaaagattggcaaagtactataaccttaataacaatagatattattccccttttcaaaaatagagagagatagactatacttattgagcacctacttatatcaaacaatgtaccaggctgggcacaccacagaggcaattcagaatggtcactgagagcatgggatctggaataaatgtaacatctggataaatgtaacttcaagtcctggtctactgcttgttaattgtacaatcttgggcaggtccaggagagtctgattcagtgggtccgagttggcctctaaaaatcggtactttttaaagatctcccaggttattcagacaaccatcagggttggggaacctatgttctcaagcagtgtttctcattcatgactatgcacttgaatcccctggaaagcttgttaaaatgcagattctgattccccaggtctggggtggagcttagattctgcttttctaacaagctccccattgatgccaatgc

SEQ ID NO: 101 - DNA, 1001 bp, Homo Sapiens
  allele 501: 12-387-177 : polymorphic base C or T
  misc_binding 481..500: 12-387-177.mis1, potential
  misc_binding 502..520: 12-387-177.mis2, complement
  primer_bind 325..343: upstream amplification primer
  primer_bind 756..776: downstream amplification primer, complement
  misc_binding 489..513: 12-387-177 potential probe
  misc_feature 212,374,378: n=a, g, c or t
tactgaagttgctcttgagatgtatttaaggtaataaaaaaattgatcgtcagggaaaagaatattcaaaaccaccatctagagagtcacaaataccttctcagaagttaactgccctatattgggagatgagaggtgaagaatgatgatgagggatagaacactgttggcaaaattctatatttcctgtttctttcatatggatatttcantttttttcatggtaaatacatcaactaaaattttcttctctaacagtgaagtgcgccacaagcaaaccagctttctttgcagagaagcttcatcaagccatgaaagtatgtaccattctacttatatgtcctgcttagaggaagaattatttgtagaaagancagnaaacctcatgttgtttgaaaatctcacatttaatatcttcccattaatgagaatcattgttctatttgatgaaagaggtaatacactaccttctcagaataaacttctgttagattcggtgcytttttttacagatgagattgtaaagtgagcctgtaagtgatttacggctcacttgtgatttgcttaaaacatgtgtcaccacgggaagggtgatgtactttcttttttaacgtgtaattttagtggcctacttcctctaaggttgtgagttttataatctcccactttatgagtctgatttgttgtttttattattctgtcttttatgccacagattaatagttgaaacttttgaaatgtcattctatgattaaggatgtagaatgatgtatttgagatcaactatgtcactttaactttactgtctgacatgcatggtattatacaaggtacctcttctattctgacattttgagcccacaaatgaatagttatgaagttatcttccttttttctttgcagctccaaaataaggaggttttcagagagagagagaaagaaagatctaactatttgaataatatgaaggaatattttgaatatatatgaataatttgaat

SEQ ID NO: 102 - DNA, 996 bp, Homo Sapiens
  allele 501: 12-389-431 : polymorphic base C or T
  misc_binding 481..500: 12-389-431.mis1, potential
  misc_binding 502..521: 12-389-431.mis2, potential complement
  primer_bind 71..90: upstream amplification primer
  primer_bind 503..519: downstream amplification primer, complement
  misc_binding 489..513: 12-389-431 potential probe
  misc_feature 708..709,711..712,715..716: n=a, g, c or t
tctaatcagttgattttgagttaattaaaagggagattatcctaggtaggcttggcctactcaggtgagtaatttaaagagagggattggggcccaccctggggtcagagagattctcatactgatctctaggaagtgagctgctgtgtcctgtgagtgccatgtggcaaggagccgtgagcaccctctagtagttgaactcagtccctaggtgatagccagcaagaaaatggagaatgacgtcctccaaccacaaggaactaatttctgtcaacagccacataaacttggaagggcatcccaagctctagaaaggtatgcaggctggcaaacaccttaagctttattagatcctgagaagaaacccaagctaagttgtacctagactcacagaaactgagatgttaaatatgtgttgctttaagccattaaatttgtggtaatttattatggagcaataaaaaattaatgtaccttgtatttcattcaattagaaaaagygaaagtatgttgagctagcctaggctcagtattttattactgagatagcatatgtctgagagtatttatatacatgtatatacacatacaaacacatacacacatatatatataaagcattgaataatttttttatgtaagttcaattaagtttgcatgtaagttggataagagttgaaacattggctttttcttaaaaataaacannannaannaaacaaacaaacaaacacctgcactttaggagcttaaagccgtgactggaagttaaaaacaagtttattatatgactcagcaatctaagtatttatcaagagaataaaaacatgttcatacaaagatgtattcacaaatattcataacaccttgttcgtaataccttaaaattggaaacagttaaaatatcttaaaaacagatgaatagagaacttcataggatgggagtactcagcaatagagagaaatgagcttctgaaatgcgaaactatggattaa

SEQ ID NO: 103 - DNA, 1001 bp, Homo Sapiens
  allele 501: 12-391-366 : polymorphic base C or T
  misc_binding 481..500: 12-391-366.mis1, potential
  misc_binding 502..521: 12-391-366.mis2, potential complement
  primer_bind 136..154: upstream amplification primer
  primer_bind 571..590: downstream amplification primer, complement
  misc_binding 489..513: 12-391-366 potential probe
  misc_feature 300,382,555: n=a, g, c or t
atctgccccaggcctctctccttggctgtggatggctgtcttctccctatgtcttcacatcatcttcccttcgaaaattcttgtcagtgctgtttcttagtctctgcccctcagcattactgtatttgtcccactagaggactaggggttcatctctttcttcctattaaatcttcaaccaggaaaggaagatatgaggagatcctcagtgcaaggaatggccctcatctcaaaggctagtaactctttccttgtactggttcacctgttctcccaaatattctggaagcttatttcatncaactatgctgttttttgttagtttgtttgtttcctgtggcttcactcttcttctatagctcctcatggtctacctgagaancacgttcagatttcccaatgctacctcacaattaatatcttgttactctctttcggttttccaccatttagtgaaagcgtgtatgtctaagagttgcctacacttaactccatatcctyagctcctatggtcttctcaaaccaatttctctccactgtgtttccaaaaccccnttatccttaaggccaccacctctttcttaatttccaagtacaagagccatttctaaatgacttccttttggagcctctttctaagtgaccattttgtatccttttgcaatgtttttcacagctttcttcctgacactttcacctgcagttgcgtcatcaggattacattatcttggcttgctttctgcccctcttaattatcttattctgtgtgttttttattttaatagttgctgccaaatgactttcaaaccaacaagcaaacaagcaccagcaatatatgagtgtatccttttctaataccatttattgctggtaaaggtgttacagaaaatttgaggtcatcaccaccctgatgggtatatatccatatactgtcatttctttaaacagtatttccctcaccagtgtaaatttgaacaacttttactgtttgtttggcaatt

SEQ ID NO: 104 - DNA, 1001 bp, Homo Sapiens
  allele 501: 12-394-85 : polymorphic base A or C
  misc_binding 481..500: 12-394-85.mis1, potential
  misc_binding 502..521: 12-394-85.mis2, potential complement
  primer_bind 417..435: upstream amplification primer
  primer_bind 930..949: downstream amplification primer, complement
  misc_binding 489..513: 12-394-85 potential probe
  misc_feature 109: n=a, g, c or t
tcattgatttagagctatgactgagggaatgtaaatttccaggcatatttagttcccttttgtgcagataaagtggttgtgacagcctgaattgcaggtccctcacccnagattcataagttaaggtcctaacccacagtacatcagaatgtgacttgttttggagatagggcctttaaagagaaatggcctctctccttgccataccacgtgagagagttttctcagaaaaaccaaacctgctgatgctttaatcttacatttctggcttctggaccttgagaaaataaatgtttattgtttaagacacccagtcttaaagacacccctagcaaactaatacagcagccactgataatcacagggtgctgtctcatgggactgagagcacactgaggcagctatgaatgtagtgaaagagccatcagagggaagagcacccatggtgtcttctctggccctaagccttcattgccaggaaaccatttgcagaacacctgmtttctgtcctcacaattttagcttttgctccattagacatcctgttttttccagaaaaggaacctgaaattgccactcatacttggtcaatgtaggctgctctaaaaagtttacccaggatagcttttatataatagagtatcaactatggacccgggaagatcatttggatacatcttgacgtttctccacctgctgataaaagtgaatgagtaaatacagcagctgtagtaggatgagggcagggtaccaagagcacagttccttcaaggctgaggaaatgtgtcccccacagaatgatcaatttagaccaccaggtacaacattaaccgaggataaggaaagtctaggatactggaagaataaaaagaacacttagttgattgattactattaaagcctctgcttagtttaatatatattaaattctgttttcttaactgcacacacagggatttccatcacagtcctaaaaaacaaaatgcatagccaactttgag

SEQ ID NO: 105 - DNA, 885 bp, Homo Sapiens
  allele 385: 12-395-382 : polymorphic base A or G
  misc_binding 365..384: 12-395-382.mis1, potential
  misc_binding 386..405: 12-395-382.mis2, potential complement
  primer_bind 5..23: upstream amplification primer
  primer_bind 530..549: downstream amplification primer, complement
  misc_binding 373..397: 12-395-382 potential probe
ccattagaggtttttggacaaaggttaattgctcaataggctgggaagttatgagaaggatctgagaatcaggggccattggattagatgccatttaaagttcactgtggctggagattctatgattctggagattctgatttcagaatgcatttttattcttccccaactcaatatgcatataaaactgactaattatgttttatatttgcatagcacttaaacactggcttatacattgttaaataaatccaaacaggtgagttaagactgtttgtttaatgctccaccgtggtttacacacctcttggtgctatagaaacaacaagctttttgtactcatcccatgtaacttcagggaactgctgtgttttttctgattcarttttgcattgttataatacaatttttatttccatgactttttgtagcaaaatatttacattttgtaaacagtggatgtcttttctaaaatttcatttttctttcttgtaagctgtaaaaagtttgtcttgtgtgctttaacttccttgcattttcccttattacagagtcaataatttttgcaaatacatatagacatattgttttaataaataattcaataattttattttaagatatgcctattattgacattttctaaataagtgccattttgtctatggctgtcttccaggccccaaccatttaaattattcaggctccagaattcactactcctatacttaggtaattagagttataaacttgagaataaacttgaccattaacttggcattaactcgaccaacttcaaaagtattgacagaaaaataaagaaaagagagggctaaaaatgcataaaaattgaaatagaatcatgacatttaactgtttattaag

SEQ ID NO: 106 - DNA, 1001 bp, Homo Sapiens
  allele 501: 12-400-217 : polymorphic base A or G
  misc_binding 482..500: 12-400-217.mis1
  misc_binding 502..521: 12-400-217.mis2, potential complement
  primer_bind 285..304: upstream amplification primer
  primer_bind 749..769: downstream amplification primer, complement
  misc_binding 489..513: 12-400-217 potential probe
tatttattttcatttcattaccattcgtgtaaggtgtgtgtgtgtgtgtgtgtgtgtgtgtgtgtatagctagtttctctatagaaattatatggaagagtaagaaggcttcactttaaaattcatgtttttaatgagagtattttctgaatatgagacacttaccctcatttattttggccagggtgttggaactcgccataaggcattgatcaggattatggtttcccgttctgaaattgacatgaatgatatcaaagcattctatcagaagatgtatggtatctccctttgccaagccatcctggtatgttttgattcctctaatgccatcccaacaaatgaaagttctttttgcaagatcttcaaggagaagagttgacttattgtatctataaatttaatatgtaagattaatttaatatattatggtgtatacttcatgagtaaattgaactttcactggtaaaatctactagtgagttctctactgaaatactrggtacatttttcaactaaagtcatggaaacatttagtttcccatgcataaattcagcaagcagaatattctagtgttccccctagggtagatagacattgtggtttattttgccattaatatttgtcagaggattagaaactccttattcaaaatatttatcttaattctatcacatgtaaaatgtttaaaatttatgttcaaattgtctcataagaatgttaaaaaataagacaaagaacagtcaagggttttggacttactgaaaggtagataacgattcaaatttaattaattagtcatattggataactaaaatctacccagaaaatgtgagaaaattacaggcactatacatttctcttcttctggtgagtgaatcaggtatctcctcacataagatatgagattatattgtgttatacttatttaattttgtgtgatatttcattcatagaaaataatggcactaatataaaacataattaattcagaaaagtt

SEQ ID NO: 107 - DNA, 1001 bp, Homo Sapiens
  allele 501: 12-400-280 : polymorphic base A or G
  misc_binding 481..500: 12-400-280.mis1, potential
  misc_binding 502..521: 12-400-280.mis2, potential complement
  primer_bind 222..241: upstream amplification primer
  primer_bind 686..706: downstream amplification primer, complement
  misc_binding 489..513: 12-400-280 potential probe
gtatagctagtttctctatagaaattatatggaagagtaagaaggcttcactttaaaattcatgtttttaatgagagtattttctgaatatgagacacttaccctcatttattttggccagggtgttggaactcgccataaggcattgatcaggattatggtttcccgttctgaaattgacatgaatgatatcaaagcattctatcagaagatgtatggtatctccctttgccaagccatcctggtatgttttgattcctctaatgccatcccaacaaatgaaagttctttttgcaagatcttcaaggagaagagttgacttattgtatctataaatttaatatgtaagattaatttaatatattatggtgtatacttcatgagtaaattgaactttcactggtaaaatctactagtgagttctctactgaaatactgggtacatttttcaactaaagtcatggaaacatttagtttcccatgcataaattcagcaagcaraatattctagtgttccccctagggtagatagacattgtggtttattttgccattaatatttgtcagaggattagaaactccttattcaaaatatttatcttaattctatcacatgtaaaatgtttaaaatttatgttcaaattgtctcataagaatgttaaaaaataagacaaagaacagtcaagggttttggacttactgaaaggtagataacgattcaaatttaattaattagtcatattggataactaaaatctacccagaaaatgtgagaaaattacaggcactatacatttctcttcttctggtgagtgaatcaggtatctcctcacataagatatgagattatattgtgttatacttatttaattttgtgtgatatttcattcatagaaaataatggcactaatataaaacataattaattcagaaaagtttgtaatctcagtcttgaaggctattgcttttttatgcaatgataaaaaatcagttatctgttg

SEQ ID NO: 108 - DNA, 880 bp, Homo Sapiens
  allele 380: 12-401-378 : polymorphic base A or G
  misc_binding 360..379: 12-401-378.mis1, potential
  misc_binding 381..400: 12-401-378.mis2, potential complement
  primer_bind 4..22: upstream amplification primer
  primer_bind 446..466: downstream amplification primer, complement
  misc_binding 368..392: 12-401-378 potential probe
  misc_feature 631: n=a, g, c or t
cctacccatacccaaggagaagaaatcatacagggcatatacatccagggccgggtatcccagggatcatattacaatcatgactaccacacaaggtaatatgttgaacttactcaagctagtttaccctgctctctccactttttctcttagtttgaatgcttacatttctgagctgaacaaaacagagtggtaattttgccacacaggtgaagggcttaaatttccattgacctagaaggatcatgccacacttgtccttattctgtttttagggtgttcactgtaatcatttcaaacgaccaccttaagaaaaggcttttgaaaatatatatatgagtcattttatagttatagtaatattgttttatgacattagrtttattttggggggttgtttcttttggcttgtcctctgtaagttattgaaatgagtttaaatccactcttggtcatctgctacattaataatattgtcctcctttatggcatatttattacacatatatcaagagacacaagtcactctggatgaaccagaaggctacaaaagaaatagtaagtagctaaaagaagactgaaaagatgaaccaataaagaagtctctgtctctctttctttctcaatactnaatgtaaaccaagtaaaactcctcttaatttgaaatgtgatgagatggtttatttcataaacaaaatccttaatatcatctggtttaacacatacatgagattctgaagcatgtctagtcagtcctcatcaggtccaagagatacaatttatcccaagtaaattctgcacattggtggagatttggaattggcttccctaatctatccagcaaatcataaatactatgctaggccttaatgttaggttt

SEQ ID NO: 109 - DNA, 823 bp, Homo Sapiens
  allele 323: 12-402-126 : polymorphic base C or T
  misc_binding 303..322: 12-402-126.mis1, potential
  misc_binding 324..343: 12-402-126.mis2, potential complement
  primer_bind 198..218: upstream amplification primer
  primer_bind 634..654: downstream amplification primer, complement
  misc_binding 311..335: 12-402-126 potential probe
taatagtacagaatccagagccatatggcttgggttcaaattccatttccaacatttactaactgtgggaccttgggcaggttgcttaaagtctctgtatgctcacctatgaaatgggaataaaaacagcaccaatttcataggactgataagcataagtaaattaatatgaataagacacctaaaagttggcctgacaaaataagagctgtatttggtaccttctgttattatctaaacagactcaaatatttagatctttgtaaaatcctgagcagctcatatattcattgcatttgttctctgagcctgtgttatatgaygggtggtattctagattcaagcactacatccatgaacagaactacaattcctgcttcaattatttcgtcatatcaatatcctgtaactgtagcctcctcaaaattccaactgatcaaaaatattgtctatttcaagatttttgcttttcaattttagtaacaaatatctagttacagaaactcatttatttacacctctaaacccaattctctttgtctcctttcatactgtttttacatttagtgcagtgcctaacatatactaagtatatatgaaaaatatgaataagtagtcaaaatggaaaatattccaaccccattcattattcaatgattttcagatgcattcttgcctgtcaattctaaaattaaaaaattctaaagaggtaacattaattcagaatatattcaaaatctcttgtggaataaatatattcttcacttttggggacggttactaggttgaaaaaaagttgtctatcttttatccaagtgtcact

SEQ ID NO: 110 - DNA, 817 bp, Homo Sapiens
  allele 317: 12-404-265 : polymorphic base A or G
  misc_binding 297..316: 12-404-265.mis1, potential
  misc_binding 318..337: 12-404-265.mis2, potential complement
  primer_bind 53..70: upstream amplification primer
  primer_bind 504..523: downstream amplification primer, complement
  misc_binding 305..329: 12-404-265 potential probe
  misc_feature 400,697: n=a, g, c or t
acacgcatccattaatattgtgggccccaaaggcctgtgaaaaagggggccttggaaacgccgttatcagtgttgtgtttaagagtgaaagtcaaattgcggaggaataactcatcctacctgggccaatgaaaccaggggcacagagcagggacatcagaagataattcaactaaatccagctgtagtagctgtcaacagcagaggacagggcgccagactccacaatgtatgtaaaaggctgggagggggcagatggtgataattactgacatttattgagctctcacaatgggctgggctatatagcaagtagrctttactgaaggacagggtagagaaataggttcaaaatgggctccggagagcttggcaaggtaagcaacgcagggtcctcagncaactctcccgggaaaagtgccctgtaagcaagggcaactttacaaccagcatgtctcaattttactgattaatcgttccttaatataaataagatctatggtgtcaatcgagaaaaatgaggagacaagtctcaatcattttaggtttatttgccaaagttaaggatgtgcgtccatgacacagcctcaggaggtcctgatgacatgtgcccaaggtggtcagggcacagcttggttttatacattttagggagacatgagacatcaatcaatgtatgtaagaactgcattgggtnccttccagaaaggtggggacaactcaaagcagggaggggggcttccaggtcacaggtaggtgaaaaacaaatggttgcattcttcgagtttctgataagcctttccaaaggaggcaatca

SEQ ID NO: 111 - DNA, 1001 bp, Homo Sapiens
  allele 501: 12-406-52 : polymorphic base C or T
  misc_binding 481..500: 12-406-52.mis1, potential
  misc_binding 502..521: 12-406-52.mis2, potential complement
  primer_bind 450..468: upstream amplification primer
  primer_bind 881..899: downstream amplification primer, complement
  misc_binding 489..513: 12-406-52 potential probe
  misc_feature 4,53,104,243,324,369: n=a, g, c or t
tttngggggtgcatacccaaaagtgaaattttcggatgatatggtaattcttngtttttgaggaacctccaccagttttttacaatacctttattaatttaaantttccatcaacagtgtacaagagttgaaattgtacatttaaaatcattataaattatattgccaaatactatagctaatgcatatcaaaaaatatgctgacatacttgggaaatctatggaaatactgaagccaacagnattaaaaatttcagcctagtaacgctatgcctgtttgtatcacagttgtgtcttttacagctccctagagaaaaacttacnaagctttctacaggatatgagaatcatgttgaaaatattatagtntcatttctgttctttctgtcagaaaatatgttctccaaaaagtgcaatagataaatttctttatttagtattctagcattctttattccaacactttcctcatttttctagaataattggctaatatcaaayattattaagacagtacgtcatcattctatagtaaatatatttactagccaagtttttctatttaaaataatttcatggttcttaatttttatgccaccattttattggagaaaggttatactgttcttcactgtcaaatatgagtagttatgataggatattttagttatcaaggctttgcactctgaacaacaccatttaggccctttaatcaaaactcaaaggatacttttaacgtccacatagacatactcacctcctaccacagaagtaggatagtttggtgaagaacccagtgaatcagaaattcctcctctcagctctgttttgatgttatttttcactaaacagccctcatgatgatttacccattatttcactgaagagggtaatgctgtccttagcttacggtggcagcagaagccatggacatatattagatcagatgctatttatttttgtttttattttttgcagatggaaaattcttaaatgtttta

SEQ ID NO: 112 - DNA, 1001 bp, Homo Sapiens
  allele 501: 12-406-409 : polymorphic base A or G
  misc_binding 481..500: 12-406-409.mis1, potential
  misc_binding 502..521: 12-406-409.mis2, potential complement
  primer_bind 93..111: upstream amplification primer
  primer_bind 524..542: downstream amplification primer, complement
  misc_binding 489..513: 12-406-409 potential probe
  misc_feature 12,717,742,755,758,1000..1001: n=a, g, c or t
aatattatagtntcatttctgttctttctgtcagaaaatatgttctccaaaaagtgcaatagataaatttctttatttagtattctagcattctttattccaacactttcctcatttttctagaataattggctaatatcaaacattattaagacagtacgtcatcattctatagtaaatatatttactagccaagtttttctatttaaaataatttcatggttcttaatttttatgccaccattttattggagaaaggttatactgttcttcactgtcaaatatgagtagttatgataggatattttagttatcaaggctttgcactctgaacaacaccatttaggccctttaatcaaaactcaaaggatacttttaacgtccacatagacatactcacctcctaccacagaagtaggatagtttggtgaagaacccagtgaatcagaaattcctcctctcagctctgttttgatgttatttttcactaaacagccctcrtgatgatttacccattatttcactgaagagggtaatgctgtccttagcttacggtggcagcagaagccatggacatatattagatcagatgctatttatttttgtttttattttttgcagatggaaaattcttaaatgttttaaatgaaggctgaagagaaccagtaaagaaagatttaaagtatgaaggagcaataatatgcccccaccaatgtncttttcctactaaactcatcaaaancaagtcacagagnaancaatgggcaaaatgtattcactttttaaaaatcttcacttaatacatggttttgttgcagtgttcttttatataggaagtcaaatttgtaacttttaaaaataaatgagatttttgtttatttgttgtctcgaaaacgtttacaaaactcactgaaagcataaacaaagattttttttgtacatttaaaataattttagaaaaactatcacatatgactaggacatacatttactatgaatnn

SEQ ID NO: 113 - DNA, 1001 bp, Homo Sapiens
  allele 501: 12-407-217 : polymorphic base G or C
  misc_binding 481..500: 12-407-217.mis1, potential
  misc_binding 502..521: 12-407-217.mis2, potential complement
  primer_bind 285..303: upstream amplification primer
  primer_bind 746..766: downstream amplification primer, complement
  misc_binding 489..513: 12-407-217 potential probe
gttcaagtgattctcctgcctcagccttctgagtagatgggactacaggtgcacaccaccatgcctggctgatttttgtacttttggtagagacggggtttcgccatgctggccaggctggtcttgaactcctggcctcaagtaatctgcccaccttggcctcctaaattgctgggattgcaggtgtgagccaccatgcacagccaaaatatataacactttggaatcaaaagggatggatttatgtctccattcttgccactactagcaggaagactgcttgaaaatagcactcagttttcccagatagaaactgaggataatgattaaaggctattattccaagcaagggttagtcattgctgttactatcattgcaaaactctgatagttctagattgtaaccaggaagatacaatcaaccacaaaactcagcttcctctgtcacaaattctagatagaggtagcctttcatgaggctgagagatggaaaaatgaagsggggggactctcttaggacacataaatatgcaaaaaaattgctacgctttagaaagctatacattcaaatcatagataagctgacattagtaggcagtgcatgttcacaaaaagaccattaattagaagaaatgtgaaatattgttaatttccttatagatttgcctatgtataaatggccaatttcaccgtcaatgagctcatgctaagtactgaaataaacttagttttagagcttatctttggttagttgaaatctgtattgagttagttgaaatctataagttgatagaacaggctctttaaaatctattgcaagctttatacactacaaacaaaaagatagaaaaaagaaaacctttcatgaactcattggcttaggcaggttttcatgcagagtgtaggtattgaagagtcagaacggcttaaggatagaatttggccaatatataaaaaaatatatatttggtatttgttagttgtattataattattcagaa

SEQ ID NO: 114 - DNA, 1001 bp, Homo Sapiens
  allele 501: 12-407-399 : polymorphic base A or T
  misc_binding 481..500: 12-407-399.mis1, potential
  misc_binding 502..521: 12-407-399.mis2, potential complement
  primer_bind 103..121: upstream amplification primer
  primer_bind 564..584: downstream amplification primer, complement
  misc_binding 489..513: 12-407-399 potential probe
ggtgtgagccaccatgcacagccaaaatatataacactttggaatcaaaagggatggatttatgtctccattcttgccactactagcaggaagactgcttgaaaatagcactcagttttcccagatagaaactgaggataatgattaaaggctattattccaagcaagggttagtcattgctgttactatcattgcaaaactctgatagttctagattgtaaccaggaagatacaatcaaccacaaaactcagcttcctctgtcacaaattctagatagaggtagcctttcatgaggctgagagatggaaaaatgaagcggggggactctcttaggacacataaatatgcaaaaaaattgctacgctttagaaagctatacattcaaatcatagataagctgacattagtaggcagtgcatgttcacaaaaagaccattaattagaagaaatgtgaaatattgttaatttccttatagatttgcctatgtataaatggccwatttcaccgtcaatgagctcatgctaagtactgaaataaacttagttttagagcttatctttggttagttgaaatctgtattgagttagttgaaatctataagttgatagaacaggctctttaaaatctattgcaagctttatacactacaaacaaaaagatagaaaaaagaaaacctttcatgaactcattggcttaggcaggttttcatgcagagtgtaggtattgaagagtcagaacggcttaaggatagaatttggccaatatataaaaaaatatatatttggtatttgttagttgtattataattattcagaagttcagttaatacgtgcagttggctttgagcccttaaccagctgtatgtgataaaatctgtttcctttagagcaatttcttatatcctgccttgatgctcctgtctttaatctttgctaagagctggtggtgaatttggctgaattcagattccgtttttctctaattgatttcttgaagaa

SEQ ID NO: 115 - DNA, 1001 bp, Homo Sapiens
  allele 501: 12-408-355 : polymorphic base G or C
  misc_binding 482..500: 12-408-355.mis1
  misc_binding 502..521: 12-408-355.mis2, potential complement
  primer_bind 147..165: upstream amplification primer
  primer_bind 587..607: downstream amplification primer, complement
  misc_binding 489..513: 12-408-355 potential probe
  misc_feature 249,251,255: n=a, g, c or t
actgcactccagcctgggcgacagagaaagactccatctcaaaaaaaaaaaaaaaaaaaaaagcaatcattaagcttttcatctagccattacttttgtacaggctctcattaattccacatagatggtctaatggtctactaaatagtattctaatcctccatcttgtctatctcttagccattctccatgataaaggatgaatggtctttcggaaacataaatgaaaccatgctgctttaaaaaaancnaacnaacaaaaagaaacccattaatgttttcccaaagctttgtggacacattgaagcttcttgtttcagcttctgccaacatttctcgctccagcaaactttcttctgcttcccaaatatgacaagcttcttctttaacttttctgccaggttaatcttgactcatttcaagagaggcttgggtcagccagggcctactctaagaagtttctttagcccttatgttttcctatggagagcacacactagstttaagtcctgagggtacttaagatgatatttcaatgtttttgtactcttagtgcttggcatatggtgggtggtctacaaatttagaacaatgtagtgaaccacaaactcctctcttcagcctgtgtgcttacttgtagtagttgtctgatctctaaaatttagaactgaatatgccaagaaagagttcaatttcagagaggagggtatggtttcattttaagtataaaagcttcctttaaaaaaaattacgtcttacattttgttatgctcctaagtgtaattgatcctggaaagtaagcgcaaggctactctctaatgctaactcttatgtatgtaagaggtgaggaaggagaggttgtgtgtggtgcatttgttttgtaaaagcatctaactgttttctttccagacactttttcaaaaatggcaatggtatcagaattcctcaagcaggcctggtttattgaaaatgaagagcaggaatatgttgtaagtagagtg

SEQ ID NO: 116 - DNA, 729 bp, Homo Sapiens
  allele 229: 12-409-221 : polymorphic base A or C
  misc_binding 209..228: 12-409-221.mis1, potential
  misc_binding 230..249: 12-409-221.mis2, potential complement
  primer_bind 9..29: upstream amplification primer
  primer_bind 435..455: downstream amplification primer, complement
  misc_binding 217..241: 12-409-221 potential probe
  misc_feature 621: n=a, g, c or t
agtgttaagttttcattctttcaattcccagtctctcattctgtattaaaccaccaatcaaagaagaagtcaacaatccagccgtggggggatgggggtagagattaagtatttttgctattttaaacaaacaataatattaatataatattcaactatccttaagaaactggtcatacaacctgtttgtaagatacatcaggttaagcaagaattgttgaacaaaatmaaaatagtattaattttgaaattacttgctaaagctagactgagaattcacctattataaacaaatcaaagtgtaagagctgtcaatgtagataatagaaacttttaagataagtttgctataaagtaatgagtctttggcaattacatagatacacacacgtacgtaaacttatgaagaatgaccccatttaaacaagacttaagcttctgcttcatgtttcttattaaaatgtattttcttattaaaacgtattttgtatgcaattttcaagaattaaatgaaattattcagtaggccaggcgcggtggctcatgcctgtaatcccagcactttgggaggttgaggcgggtggatcacgaggtcaggagagatcaagaccatcctggctnaacatggtgaaaccccgtctctacttaaaaaaatacaaaaaattagccgggcatggtggcgggtacctgtagtcacagctacgtgggaggctgaagaaggagaatggc

SEQ ID NO: 117 - DNA, 986 bp, Homo Sapiens
  allele 486: 12-410-301 : polymorphic base C or T
  misc_binding 466..485: 12-410-301.mis1, potential
  misc_binding 487..506: 12-410-301.mis2, potential complement
  primer_bind 187..206: upstream amplification primer
  primer_bind 636..656: downstream amplification primer, complement
  misc_binding 474..498: 12-410-301 potential probe
taacaggatggtctcgatttcccgacctcgtgatctgccggcctcggcctcccaaagtgctgggattacaggcgtgagccaccgcgctcggccgagctatacctacattttatacatgtcttcaatgacacatttatgattaaactaaagatgttggaatgaaaatgacaagtgatcatttctcaacatacaagaaagtctatctcagtgtatccatgggccaggaagagaatacactttaataaatgtgtttttttggggactagcccaggctgagaaaggaaaagtctctggtagttccatcaggtcttagtttcctgggtatacataactctgtattatttggctgagaaattaaaggattttccttcagtgtattcttaaatcatattatactgacattttattattctcatgttttctttcattatgaaaaaattgttggggaggtgagcatttgcaaacctctttttatattgcgtttaytatgtggaactgggaatctctgaaactccttttactttgtactaagtggctatggaaaacatctttcgagaatgaaggacaaattctcagaggaaaaatactgaataaaaggtttcaactcttgctggcattacagtatttcctcacaaggggagtgcatttcaaatagtctctttttttgtgtaatacagaggaaagcataattttttctaaagttggcatcactacaaaaagtcagtcaatgctcaacttctggtatttgattggttgtgaggggttttgctttgttttgtttctgtatgtggagaggaaagggaccaagccagcctttctggattttggagctgatatactctagcaccacctactgggaaagggtttatagtgccccaaattataagaaacccaaactcaaaatcctctgatgccttctctcaaaactttcatttatttttcttcttttcctattcttttattttctgttgattttctattcattt

SEQ ID NO: 118 - DNA, 1001 bp, Homo Sapiens
  allele 501: 10-395-101 : polymorphic base A or G
  misc_binding 481..500: 10-395-101.mis1, potential
  misc_binding 502..521: 10-395-101.mis2, potential complement
  primer_bind 406..425: upstream amplification primer
  primer_bind 797..816: downstream amplification primer, complement
  misc_binding 489..513: 10-395-101 potential probe
gaaaatctgtccatcgtctttctcataaatactttaatatcttccaagtatcattggactaagaaagtaattatgggtaataataaagattccaattaagaattagggcaacatgaaaatgctactaatttcgattcatatcgtagctttcaggtccttctcaatatgtttaattacttgtgagaaatacagaagtagtggctggttcggcaagcccatcaccttttatgagaagtagaagactcagttttatcctgtctgaacaggttgcattagccatggggaacattttgtttttgcattcacacatcagtctccccaggttctgtttacacagaggaagagaaagactggctagtttagtagtccatcccaacccaaggcagaccatctctgaggtttagtttttacagtcgtaagatgggaattgcatctgtttgcaaaaactactccaatatcgtcagatgaaatggtccaaggagtagaaattagcataatgartcgctgtgcttcagagtaaaggagagcctcttcataaagactttttgttgtactttttttccagcttccttcaaaatgtctactgttcacgaaatcctgtgcaagctcagcttggagggtgatgtaagtatatcactttcactttatataatttttgcaagttggacatctctctggataaccatattactctctatccttgtacatctaaggaagatggggacaattcagacagtcatcatttggttctcctctttcttaatacttcagctgttcctagtagttcaatttgaaggaaatatcatggcactggaaacttttcttggcctcacattaaaattggacagaattagtgacactggaatggctggaattttattctgccatacttagcatgtcattggtaataactgttatgatggtacatgacttttaatgtcatgtcctgggattttattactggttggcataagccacagccatatcaaaactaattctgc

SEQ ID NO: 119 - DNA, 1001 bp, Homo Sapiens
  allele 501: 10-395-124 : polymorphic base A or G
  misc_binding 481..500: 10-395-124.mis1, potential
  misc_binding 502..521: 10-395-124.mis2, potential complement
  primer_bind 384..403: upstream amplification primer
  primer_bind 775..794: downstream amplification primer, complement
  misc_binding 489..513: 10-395-124 potential probe
tcataaatactttaatatcttccaagtatcattggactaagaaagtaattatgggtaataataaagattccaattaagaattagggcaacatgaaaatgctactaatttcgattcatatcgtagctttcaggtccttctcaatatgtttaattacttgtgagaaatacagaagtagtggctggttcggcaagcccatcaccttttatgagaagtagaagactcagttttatcctgtctgaacaggttgcattagccatggggaacattttgtttttgcattcacacatcagtctccccaggttctgtttacacagaggaagagaaagactggctagtttagtagtccatcccaacccaaggcagaccatctctgaggtttagtttttacagtcgtaagatgggaattgcatctgtttgcaaaaactactccaatatcgtcagatgaaatggtccaaggagtagaaattagcataatgaatcgctgtgcttcagagtaaagragagcctcttcataaagactttttgttgtactttttttccagcttccttcaaaatgtctactgttcacgaaatcctgtgcaagctcagcttggagggtgatgtaagtatatcactttcactttatataatttttgcaagttggacatctctctggataaccatattactctctatccttgtacatctaaggaagatggggacaattcagacagtcatcatttggttctcctctttcttaatacttcagctgttcctagtagttcaatttgaaggaaatatcatggcactggaaacttttcttggcctcacattaaaattggacagaattagtgacactggaatggctggaattttattctgccatacttagcatgtcattggtaataactgttatgatggtacatgacttttaatgtcatgtcctgggattttattactggttggcataagccacagccatatcaaaactaattctgcatcttttggatttcttacagtg

SEQ ID NO: 120 - DNA, 1001 bp, Homo Sapiens
  allele 501: 10-395-155 : polymorphic base A or T
  misc_binding 481..500: 10-395-155.mis1, potential
  misc_binding 502..521: 10-395-155.mis2, potential complement
  primer_bind 354..373: upstream amplification primer
  primer_bind 745..764: downstream amplification primer, complement
  misc_binding 489..513: 10-395-155 potential probe
attggactaagaaagtaattatgggtaataataaagattccaattaagaattagggcaacatgaaaatgctactaatttcgattcatatcgtagctttcaggtccttctcaatatgtttaattacttgtgagaaatacagaagtagtggctggttcggcaagcccatcaccttttatgagaagtagaagactcagttttatcctgtctgaacaggttgcattagccatggggaacattttgtttttgcattcacacatcagtctccccaggttctgtttacacagaggaagagaaagactggctagtttagtagtccatcccaacccaaggcagaccatctctgaggtttagtttttacagtcgtaagatgggaattgcatctgtttgcaaaaactactccaatatcgtcagatgaaatggtccaaggagtagaaattagcataatgaatcgctgtgcttcagagtaaaggagagcctcttcataaagactttttgttgtwctttttttccagcttccttcaaaatgtctactgttcacgaaatcctgtgcaagctcagcttggagggtgatgtaagtatatcactttcactttatataatttttgcaagttggacatctctctggataaccatattactctctatccttgtacatctaaggaagatggggacaattcagacagtcatcatttggttctcctctttcttaatacttcagctgttcctagtagttcaatttgaaggaaatatcatggcactggaaacttttcttggcctcacattaaaattggacagaattagtgacactggaatggctggaattttattctgccatacttagcatgtcattggtaataactgttatgatggtacatgacttttaatgtcatgtcctgggattttattactggttggcataagccacagccatatcaaaactaattctgcatcttttggatttcttacagtgtccaggaagttattccagatgaagacttat

SEQ ID NO: 121 - DNA, 1001 bp, Homo Sapiens
  allele 501: 10-395-294 : polymorphic base C or T
  misc_binding 481..500: 10-395-294.mis1, potential
  misc_binding 502..521: 10-395-294.mis2, potential complement
  primer_bind 216..235: upstream amplification primer
  primer_bind 607..626: downstream amplification primer, complement
  misc_binding 489..513: 10-395-294 potential probe
agaagtagtggctggttcggcaagcccatcaccttttatgagaagtagaagactcagttttatcctgtctgaacaggttgcattagccatggggaacattttgtttttgcattcacacatcagtctccccaggttctgtttacacagaggaagagaaagactggctagtttagtagtccatcccaacccaaggcagaccatctctgaggtttagtttttacagtcgtaagatgggaattgcatctgtttgcaaaaactactccaatatcgtcagatgaaatggtccaaggagtagaaattagcataatgaatcgctgtgcttcagagtaaaggagagcctcttcataaagactttttgttgtactttttttccagcttccttcaaaatgtctactgttcacgaaatcctgtgcaagctcagcttggagggtgatgtaagtatatcactttcactttatataatttttgcaagttggacatctctctggataaccatattaytctctatccttgtacatctaaggaagatggggacaattcagacagtcatcatttggttctcctctttcttaatacttcagctgttcctagtagttcaatttgaaggaaatatcatggcactggaaacttttcttggcctcacattaaaattggacagaattagtgacactggaatggctggaattttattctgccatacttagcatgtcattggtaataactgttatgatggtacatgacttttaatgtcatgtcctgggattttattactggttggcataagccacagccatatcaaaactaattctgcatcttttggatttcttacagtgtccaggaagttattccagatgaagacttatacttttattttatttattaatttattcattttttgagatggagtctcactctgttgccaggctggagtgcagtggcgtgatctcggctcactgcaacctccacctcctgggttcaagcaattctcctgcctcagcctc

SEQ ID NO: 122 - DNA, 1001 bp, Homo Sapiens
  allele 501: 10-396-100 : polymorphic base A or G
  misc_binding 481..500: 10-396-100.mis1, potential
  misc_binding 502..521: 10-396-100.mis2, potential complement
  primer_bind 402..420: upstream amplification primer
  primer_bind 735..752: downstream amplification primer, complement
  misc_binding 489..513: 10-396-100 potential probe
gtctggccagaccaccttggtgccacagtggtgaccaaagtaaagaggtgggagaagctgcttccctcatttatctgaattgtaagctcagcaacactggcccagtagaaattcatgtacctgtagcagaaacttagctaaacacccttgtccttgaggcatttccacattttcagcttatttcgaattgttgccagcccagtttaatggtcttcagagccatcctgagtaaatgctggcttcaggtctccagctttgcattgtctacttttgatctctcactaaaagtaagatgagaagttgaaattgagacagcatattctaaactagctgagcctttgaagaattcttattagaaaaaatgaaattgcttgcgtgaagtgtgatggtgtgttaatacctacctagttacctagtatgagaatgatctgaattgttaaaagaaacaataggaaaacatattaggcattgttatttcaacaagaggattttaaatgtgtrtcatttgagtatgtttatcttttaacctcagcactctacacccccaagtgcatatgggtctgtcaaagcctatactaactttgatgctgagcgggatgctttgaacattgaaacagccatcaagaccaaaggtaggtgatacatttgtcctcttcttgtcagggtcttactgagacatttttggttgtctctttattctccctcaaatcgccatacgttggcgatttgaaattgtcatcgagctttaatggagtagatccagacctagctcaacccatgcctcctttccttccttccctccttcctttctttctttttccttttctccttccctcccttctccctttcttccttctctccctctttctctttctcccttcttcctgctcttccttccttcctccctccctcccctcccttctttcctttcctccctcccttccattctttcctcccccaccccccgtttcttctctttggagagatgtacagcatgagat

SEQ ID NO: 123 - DNA, 1001 bp, Homo Sapiens
  allele 501: 10-397-201 : polymorphic base G or T
  misc_binding 481..500: 10-397-201.mis1, potential
  misc_binding 502..521: 10-397-201.mis2, potential complement
  primer_bind 301..319: upstream amplification primer
  primer_bind 707..724: downstream amplification primer, complement
  misc_binding 489..513: 10-397-201 potential probe
  misc_feature 958: n=a, g, c or t
tgcccccacgtcttttacagtatatcgggaggccacaagatctgcttgccaggaggctgtctgctcaaacatctccttcttagcaggggccttgatctccgaaagcgtcctgccttccacggagtgttactgctttcaagcatattgcaaagtgcctgcactctcacagctttcttaggaatcacatacgactccagtttccttttattgaccggggaagacggcaaaattaacttggattttaaggaatttcgttgaagcaaagcctgatgtttatgtttctgagatgtgggtctgttgaagggaatgcagttgagggcgtttgacccaagactccggagtggtcaaagactcacaacctgcttcacaaaaagatccctcttacttttgttttactcactagttttaaagtaaaataaatattttccttatgattgcctgttatcttgaaggaacttgcatcagcactgaagtcagccttatctggccacctggagacgktgattttgggcctattgaagacacctgctcagtatgacgcttctgagctaaaagcttccatgaaggtaaatgcatgtgagatgtcatctctgtcaaatctgctattaattttgtgaattacagctttctgagtgtaatttggtgattttcagttttgttgaattctcatttggaaccattttttaaaaatgaactgaagttatatgtctcaggatttgtaccaaaaatatttcaattacttgttttaagactgtaaagaaatttcatgatgctgagaagtcagttaccagctgctactactcagcacctgggcaattggaataccatttgggaaaactacttccttgattacacttcctcctttaaaaagatatgttgtgatattaaggcaagaaaaaaaaactcatagcttttgttaagtgaagcttgcaaattctgcccatcctttcgtgggtgntttcttcctcccatactctctctgtcagtaccatttgtttcaa

SEQ ID NO: 124 - DNA, 1001 bp, Homo Sapiens
  allele 501: 10-399-178 : polymorphic base A or G
  misc_binding 481..500: 10-399-178.mis1, potential
  misc_binding 502..521: 10-399-178.mis2, potential complement
  primer_bind 324..341: upstream amplification primer
  primer_bind 618..635: downstream amplification primer, complement
  misc_binding 489..513: 10-399-178 potential probe
gtatcaggaacattacagttcttctctagctactgtatttcaatatagatgctattttgaatattgaaatatactttcattcaaaagcattgtttaattcttagtagtttttgccgctgtgcattttctcagtggacagtaaagcacaattgtgtgtgtgtgtgtgcgtgtgtagacctccaatttttttgatgttcagaacaagtactcacagtcaggagggctgggagccagtatttaaactacacgagaggtcaccaatcaacggtgagcctgaggatccctgatttgatctagccctgctgccccctgttatggataataactctggctctgatttcatgagggcgaaaatcattctagtgaatccttcctctgtttggggttagggagaatggatatgtccagctgacgtagctgttctgcttctcagagtcttagtgggaaatggggagattggggtggatggttggctacacaggcagaaagcataaaaccagrtgtattttcctccaagtgtacaagactgatctggagaaggacattatttcggacacatctggtgacttccgcaagctgatggttgccctggcaaaggttggtttcccagtttctttctttgcccttgcttcctcccaaggcaagtcacatacctcattttatacttggagtgaattaactaaatcccctgtgcctgcatcagaaattcagctgcatttttgaaagtgggtttgcactgtcactgcagagttgtcaattttgtataataggatttcttatcctgcaaaacctcatggacaagtggactttgggagccagagaagggatgggcggctctcaagtcctggcctggatttatgtgccagagccttggccgtgtgacttagggaaggtcactttgcctctatctgttgtcatgcaggacccagtgggaagtgaccttctggtttctttttcactgcgtttacttctcatggaagaatttgcccatatagtccttt

SEQ ID NO: 125 - DNA, 1001 bp, Homo Sapiens
  allele 501: 10-400-369 : polymorphic base A or T
  misc_binding 481..500: 10-400-369.mis1, potential
  misc_binding 502..521: 10-400-369.mis2, potential complement
  primer_bind 134..153: upstream amplification primer
  primer_bind 533..552: downstream amplification primer, complement
  misc_binding 489..513: 10-400-369 potential probe
atgaatacaagctcttggtccctcctttcttattcaaggaaggagattgtacagcagacctcacgaactatctgcagtctcatatggtatccatctgtgcctaaggaagactgcttgtgattaagacttttgacctaaatagtaggtctctgcccatgtctgcagtataatcatctttcctcgtttggcattttgaatgtgtagctttttttgttttttttgcatgacattttttttgacgttacattggatgtgtagttaacttttcctggttggttgtactcgtaggatctctatgacgctggagtgaagaggaaaggaactgatgttcccaagtggatcagcatcatgaccgagcggagcgtgccccacctccagaaaggtgggcactgtgctgagggagtctcagtgccttggggccctggctggggcggctgggtggatgtccatgttgggatggagtctgccagaatgaggttctgtctccgcttggcactctcwtaggctcacccattttccctcacctttctctcccattctggattcttttctcttgcaaatagtttctgcatttggtgctttattctgtagctccttcttgtttgatgatcattttgtcttgccattatttgttgaagtagtggactttggtgcatgctctgtactgtttcctatggttttcggatggaatgggttccactcaggggagatagagatggtccaaatatgtggcctgggcagtgccattcaggacaggtggtatggctgttccacgacaaacttggccaatgttggctctggtcaccgtggtaacctctaagctcctaggatgctgtgatcatcctcaatttttaaaaaaattatggtgcataaaactaggtgggtgatcgttgacagctttgactagtggctcggatctgataactctttgttgtttttcctcagtatttgataggtacaagagttacagcccttatgacatgttggaaagcatcaggaaa

SEQ ID NO: 126 - DNA, 997 bp, Homo Sapiens
  allele 497: 10-392-20 : polymorphic base A or G
  misc_binding 477..496: 10-392-20.mis1, potential
  misc_binding 498..517: 10-392-20.mis2, potential complement
  primer_bind 478..495: upstream amplification primer
  primer_bind 906..924: downstream amplification primer, complement
  misc_binding 485..509: 10-392-20 potential probe
agaggaaaggaactgatgttcccaagtggatcagcatcatgaccgagcggagcgtgccccacctccagaaaggtgggcactgtgctgagggagtctcagtgccttggggccctggctggggcggctgggtggatgtccatgttgggatggagtctgccagaatgaggttctgtctccgcttggcactctcttaggctcacccattttccctcacctttctctcccattctggattcttttctcttgcaaatagtttctgcatttggtgctttattctgtagctccttcttgtttgatgatcattttgtcttgccattatttgttgaagtagtggactttggtgcatgctctgtactgtttcctatggttttcggatggaatgggttccactcaggggagatagagatggtccaaatatgtggcctgggcagtgccattcaggacaggtggtatggctgttccacgacaaacttggccaatgttggctctggtcaccrtggtaacctctaagctcctaggatgctgtgatcatcctcaatttttaaaaaaattatggtgcataaaactaggtgggtgatcgttgacagctttgactagtggctcggatctgataactctttgttgtttttcctcagtatttgataggtacaagagttacagcccttatgacatgttggaaagcatcaggaaagaggttaaaggagacctggaaaatgctttcctgaacctgggtaagtgaatgtggcccccattcctggtagacatcagctaccagagcagaagtgacagatggccatcctcttaatccaaatgtgtttgggaggtgtggcttctatgcatgctttggatagttttacagtcttaattgtatagatttcagaatataaaactgaagaaaggcctaacttggtaacagattgttgccagggaggagtaagagaacaggaggagagaggggtgtgttgtggaaactcacgtatgcacttgggttctgcag

SEQ ID NO: 127 - DNA, 1001 bp, Homo Sapiens
  allele 501: 10-392-103 : polymorphic base A or G
  misc_binding 481..500: 10-392-103.mis1, potential
  misc_binding 502..521: 10-392-103.mis2, potential complement
  primer_bind 399..416: upstream amplification primer
  primer_bind 827..845: downstream amplification primer, complement
  misc_binding 489..513: 10-392-103 potential probe
ctgtgctgagggagtctcagtgccttggggccctggctggggcggctgggtggatgtccatgttgggatggagtctgccagaatgaggttctgtctccgcttggcactctcttaggctcacccattttccctcacctttctctcccattctggattcttttctcttgcaaatagtttctgcatttggtgctttattctgtagctccttcttgtttgatgatcattttgtcttgccattatttgttgaagtagtggactttggtgcatgctctgtactgtttcctatggttttcggatggaatgggttccactcaggggagatagagatggtccaaatatgtggcctgggcagtgccattcaggacaggtggtatggctgttccacgacaaacttggccaatgttggctctggtcaccgtggtaacctctaagctcctaggatgctgtgatcatcctcaatttttaaaaaaattatggtgcataaaactaggtgggtgatcrttgacagctttgactagtggctcggatctgataactctttgttgtttttcctcagtatttgataggtacaagagttacagcccttatgacatgttggaaagcatcaggaaagaggttaaaggagacctggaaaatgctttcctgaacctgggtaagtgaatgtggcccccattcctggtagacatcagctaccagagcagaagtgacagatggccatcctcttaatccaaatgtgtttgggaggtgtggcttctatgcatgctttggatagttttacagtcttaattgtatagatttcagaatataaaactgaagaaaggcctaacttggtaacagattgttgccagggaggagtaagagaacaggaggagagaggggtgtgttgtggaaactcacgtatgcacttgggttctgcaggcctcagagacccctggtttaaaaccgtggtggaacttagtattgcagaggatttctacatttcccttagcctgtcctatttt

SEQ ID NO: 128 - DNA, 1001 bp, Homo Sapiens
  allele 501: 10-392-324 : polymorphic base G or C
  misc_binding 481..500: 10-392-324.mis1, potential
  misc_binding 502..521: 10-392-324.mis2, potential complement
  primer_bind 178..195: upstream amplification primer
  primer_bind 606..624: downstream amplification primer, complement
  misc_binding 489..513: 10-392-324 potential probe
cattttgtcttgccattatttgttgaagtagtggactttggtgcatgctctgtactgtttcctatggttttcggatggaatgggttccactcaggggagatagagatggtccaaatatgtggcctgggcagtgccattcaggacaggtggtatggctgttccacgacaaacttggccaatgttggctctggtcaccgtggtaacctctaagctcctaggatgctgtgatcatcctcaatttttaaaaaaattatggtgcataaaactaggtgggtgatcgttgacagctttgactagtggctcggatctgataactctttgttgtttttcctcagtatttgataggtacaagagttacagcccttatgacatgttggaaagcatcaggaaagaggttaaaggagacctggaaaatgctttcctgaacctgggtaagtgaatgtggcccccattcctggtagacatcagctaccagagcagaagtgacagatggccatcctsttaatccaaatgtgtttgggaggtgtggcttctatgcatgctttggatagttttacagtcttaattgtatagatttcagaatataaaactgaagaaaggcctaacttggtaacagattgttgccagggaggagtaagagaacaggaggagagaggggtgtgttgtggaaactcacgtatgcacttgggttctgcaggcctcagagacccctggtttaaaaccgtggtggaacttagtattgcagaggatttctacatttcccttagcctgtcctattttgcagcccttttccattgcattaggtcacttctggtttgtggcccagggccagggcatcctctctcattggtagaggagagaccagagcagctgcagcgctgactccctttcttctctccacagttcagtgcattcagaacaagcccctgtattttgctgatcggctgtatgactccatgaaggtaagggcagctggctgagagagctgtgtttccacactc

SEQ ID NO: 129 - DNA, 1001 bp, Homo Sapiens
  allele 501: 10-393-27 : polymorphic base G or C
  misc_binding 481..500: 10-393-27.mis1, potential
  misc_binding 502..521: 10-393-27.mis2, potential complement
  primer_bind 475..493: upstream amplification primer
  primer_bind 879..896: downstream amplification primer, complement
  misc_binding 489..513: 10-393-27 potential probe
gtgcataaaactaggtgggtgatcgttgacagctttgactagtggctcggatctgataactctttgttgtttttcctcagtatttgataggtacaagagttacagcccttatgacatgttggaaagcatcaggaaagaggttaaaggagacctggaaaatgctttcctgaacctgggtaagtgaatgtggcccccattcctggtagacatcagctaccagagcagaagtgacagatggccatcctcttaatccaaatgtgtttgggaggtgtggcttctatgcatgctttggatagttttacagtcttaattgtatagatttcagaatataaaactgaagaaaggcctaacttggtaacagattgttgccagggaggagtaagagaacaggaggagagaggggtgtgttgtggaaactcacgtatgcacttgggttctgcaggcctcagagacccctggtttaaaaccgtggtggaacttagtattgcagaggatttctasatttcccttagcctgtcctattttgcagcccttttccattgcattaggtcacttctggtttgtggcccagggccagggcatcctctctcattggtagaggagagaccagagcagctgcagcgctgactccctttcttctctccacagttcagtgcattcagaacaagcccctgtattttgctgatcggctgtatgactccatgaaggtaagggcagctggctgagagagctgtgtttccacactcagcttttcttcttttgggtcccaaattgagtctccttgattcatggatgggggaaggggaccccactgtgtggatgcaggaacacactagtcagctgtggttgtatgtgacagctgagagaaccacaaatctgtcttctttctctcagctgcttgaacatgtatttgcgtacagacaaaaagtaaagtgccatgggagagagaaaatgcgacatggtagtcgtgtctgatccctgctcaggtttctccgtgattt

SEQ ID NO: 130 - DNA, 1001 bp, Homo Sapiens
  allele 501: 10-393-324 : polymorphic base A or G
  misc_binding 481..500: 10-393-324.mis1, potential
  misc_binding 502..521: 10-393-324.mis2, potential complement
  primer_bind 179..197: upstream amplification primer
  primer_bind 583..600: downstream amplification primer, complement
  misc_binding 489..513: 10-393-324 potential probe
ttttacagtcttaattgtatagatttcagaatataaaactgaagaaaggcctaacttggtaacagattgttgccagggaggagtaagagaacaggaggagagaggggtgtgttgtggaaactcacgtatgcacttgggttctgcaggcctcagagacccctggtttaaaaccgtggtggaacttagtattgcagaggatttctacatttcccttagcctgtcctattttgcagcccttttccattgcattaggtcacttctggtttgtggcccagggccagggcatcctctctcattggtagaggagagaccagagcagctgcagcgctgactccctttcttctctccacagttcagtgcattcagaacaagcccctgtattttgctgatcggctgtatgactccatgaaggtaagggcagctggctgagagagctgtgtttccacactcagcttttcttcttttgggtcccaaattgagtctccttgattcatggatggrggaaggggaccccactgtgtggatgcaggaacacactagtcagctgtggttgtatgtgacagctgagagaaccacaaatctgtcttctttctctcagctgcttgaacatgtatttgcgtacagacaaaaagtaaagtgccatgggagagagaaaatgcgacatggtagtcgtgtctgatccctgctcaggtttctccgtgatttcttcctgttactgccagagtcaagacaagtgaggaagggagcgattattaagcacccactatacagtggacaagtgctactattttaccttaaatcattgcataacaacctctgaggcttatatgattatcttctttataaatgcagagatggagctcagaatacctcagcctgcttgaagttacacagacagatttgaacctgggtctatcagaccccaaagacagccccacaacccttccctaaacgaaccacctcttcccgtagacccatcccattttctacacctcaagtgt

SEQ ID NO: 131 - DNA, 1001 bp, Homo Sapiens
  allele 501: 12-727-237 : polymorphic base A or G
  misc_binding 481..500: 12-727-237.mis1, potential
  misc_binding 502..521: 12-727-237.mis2, potential complement
  primer_bind 265..284: upstream amplification primer
  primer_bind 694..714: downstream amplification primer, complement
  misc_binding 489..513: 12-727-237 potential probe
ccagctaatttttgtatttttagttgagactgggtttcaccatgttggccaggatggttttgatctcttgacttcgtgatctgcctgccttggcctcccaaagtgctgggattacaggtgggagccaccatgcctggctcgaggacctatactttaaaaaatttcacacctggaaaatattttctctaaaaaagctaggatatttcttttaaaaaaccaagaatataatgaaattattgtaattcatctgtttcctttttttctgtggctattagggaatttagaactaaactgaattttctttcataggaaatatgtgaacctagaaattctgttgcatttgtttcttttttttacaaataaaaaatttaagctatatgtgaagttaaaattatttcaaatacttttagaatcaagtggaatataaattatgaatatgtaaaatagctaatggtactatacatcttccaggtcatcctggcagaaatggcttttacgcaractcagcactgatactggtttgtagccatatccgacagatctttcaaaatattctttgattgaaattaaaatgcaatgaatcactcaacagagggttgacagtgacttgggtcacatggtgcaagaccctctgtattgttcatggtacttgccatcaaaatgttcaaattaatggagcctgtgaaagcacaggttgtatggagtataaagcctatagagtttttttaaaatcttttttcttcttgaaacgtgtgcatgctgtttttgggaacaatacaaactgcatgttgaagtcagacaaattcaggtgctaaataatttgtttctctaatggacttagattgtatttgctatcaggttttataagagggctttttgtgtagcctctgaagttactctagtatatttcttatgtgtggagaggtggggcagaaatagaaaatgtcacatgttccccattattttaaggaaagaaaagataactttgtctcactaatttc

SEQ ID NO: 132 - DNA, 1001 bp, Homo Sapiens
  allele 501: 12-728-224 : polymorphic base A or G
  misc_binding 481..500: 12-728-224.mis1, potential
  misc_binding 502..521: 12-728-224.mis2, potential complement
  primer_bind 277..295: upstream amplification primer
  primer_bind 720..740: downstream amplification primer, complement
  misc_binding 489..513: 12-728-224 potential probe
  misc_feature 473,582: n=a, g, c or t
ttaagcttgaggtttgaggctctcaagaaaaaaggaaagagagtgtacacattgggtagaggatgctgacgaaagagatagaacaaatcttggtgtctgggtatttcagtttggaaaacagtatataaatttcagtttgaaaaagtctgcttgacaccttctatgtaagcccaaaatactagagtatactgagtaacgattaacaacttgtatttccataggtgtggatgaggtcaccattgtcaacattttgaccaaccgcagcaatgcacagagacaggatattgccttcgcctaccagagaaggaccaaaaaggtacaggcaattccagggatggagggcatttcttgttgaatttttgtttcctcagacattgctttttcttttcatgaattgtggctctcatgcgcaaaagacttgtgggacccttggatatctaagattttcttcttaaatccttgtaagagtcacntgcacatgtgtgtgtgcgtgtgtgcacrcgcgcgtgcacctcaggtcatcaggcattaggttctcataaggagtgtacaacatagatccctcgcgtgtgcagttcacangtagggttcgcgcttctgtgagaatctcatgccaccgttgatctgagaggaggcagagcgcagatggtcacgctcgctttagagtgcttgggagctcctgtgtaaggacagtaccctcccccaacccaggctacctggagggagagcttctgggaatagaaagttaggaataggaaacaacaacaataacaacaacaggcaccatttattgagtgcttactttgggccaggcactgtgctcagttttgtacatgtagcaactcatttcatctttatgacttctgctggttcttgataagatgtttctaatttaattttaggatactagcctccactgagtgttgatcctaacaagctcctctcattttaaaaatatacacttgaattcttaagctttttgcaacgagtgggcttagttg

SEQ ID NO: 133 - DNA, 1001 bp, Homo Sapiens
  allele 501: 12-730-142 : polymorphic base A or G
  misc_binding 481..500: 12-730-142.mis1, potential
  misc_binding 502..521: 12-730-142.mis2, potential complement
  primer_bind 360..378: upstream amplification primer
  primer_bind 867..887: downstream amplification primer, complement
  misc_binding 489..513: 12-730-142 potential probe
tgggtgtggacacaaagcctaaccatatcaatggtcaaataagaatggaaaaaatattgggtttaattacattcaatagactcctttctttcaaggcagggattctcagaagtaatacatatgtcagcctacttttcattgacatgaatataaaatcctcatttcacagaacacctgtgaatatattgaataacattagtattcaacagaacaggatcaggaaacttcctctagaaggcgctttccaaataaagaccaaatacactgctgcaggagggaagaataaattcatttacatatatgtctgtggtaagggataaaatcttaaatttttgctggcttcacttatatgaaataattcagtgatttgggattttgtgttagttagctcttgttgcaataagtctacataacaaacaatttccatatctcagacatttataacattaacttctcattcacaggtctgaatcctggctgggacagtttggctttaagtartacatcaaattcaggtgtgttccatgtgtttttcattcaggaatccaggcaaaaaagctgtggctacctcagtgtgcttttctcgtggtgtagaacaggtgcacaaaattgctggcaaacatttaccaaacctcttaagcctcagcctagaactgatcacctatcactttaccacattccattggtcaaagaaagtcatatggccacacccaaaactagtggggcagggtggtatattctacccacagagaagacaggcaagggcagggagagaaggaagaatggtaagtaactaataatattcactacattgaccataaattcaagatttaaccatgtgtgggaattcaatcatatttttatttcctttaaacacaaatgtcctggtcaataattcaaacgtgcacattattagacttaataataggaatatagagcccacttcttttctttcttcttgttcttccttgctttggaaaagtcagcattcaatgtgtatg

SEQ ID NO: 134 - DNA, 1001 bp, Homo Sapiens
  allele 501: 12-730-193 : polymorphic base A or G
  misc_binding 481..500: 12-730-193.mis1, potential
  misc_binding 502..521: 12-730-193.mis2, potential complement
  primer_bind 309..327: upstream amplification primer
  primer_bind 816..836: downstream amplification primer, complement
  misc_binding 489..513: 12-730-193 potential probe
aaatattgggtttaattacattcaatagactcctttctttcaaggcagggattctcagaagtaatacatatgtcagcctacttttcattgacatgaatataaaatcctcatttcacagaacacctgtgaatatattgaataacattagtattcaacagaacaggatcaggaaacttcctctagaaggcgctttccaaataaagaccaaatacactgctgcaggagggaagaataaattcatttacatatatgtctgtggtaagggataaaatcttaaatttttgctggcttcacttatatgaaataattcagtgatttgggattttgtgttagttagctcttgttgcaataagtctacataacaaacaatttccatatctcagacatttataacattaacttctcattcacaggtctgaatcctggctgggacagtttggctttaagtagtacatcaaattcaggtgtgttccatgtgtttttcattcaggaatccaggcraaaaagctgtggctacctcagtgtgcttttctcgtggtgtagaacaggtgcacaaaattgctggcaaacatttaccaaacctcttaagcctcagcctagaactgatcacctatcactttaccacattccattggtcaaagaaagtcatatggccacacccaaaactagtggggcagggtggtatattctacccacagagaagacaggcaagggcagggagagaaggaagaatggtaagtaactaataatattcactacattgaccataaattcaagatttaaccatgtgtgggaattcaatcatatttttatttcctttaaacacaaatgtcctggtcaataattcaaacgtgcacattattagacttaataataggaatatagagcccacttcttttctttcttcttgttcttccttgctttggaaaagtcagcattcaatgtgtatgtgtgccaatccagggaagtcagaagactatggcatcttccatccagattcc

SEQ ID NO: 135 - DNA, 1001 bp, Homo Sapiens
  allele 501: 12-731-60 : polymorphic base C or T
  misc_binding 481..500: 12-731-60.mis1, potential
  misc_binding 502..521: 12-731-60.mis2, potential complement
  primer_bind 442..462: upstream amplification primer
  primer_bind 898..918: downstream amplification primer, complement
  misc_binding 489..513: 12-731-60 potential probe
tctcctgacctcatgatctacctgcctcagcctcaagaagtgcgggattacaggtgtgagcctccacgcctggccttctgattatttctttattatagcattctattcttgctttgtggatgcaaaatcatctcttatcttactttaatttttttcttctctctgaattctctctattttctcaaatttatttttttgtttcttttcttaggtgtttgtatttcctttcagagtgaagatatcctcaaatgtctagtgatccttaactgtctgttcacatttaagactacagcactaaaaatctgattggaagttctgatatatgagttgggttgccaactctgggtcttaccccaggtaatctggctggattgtttcataggacaactcccaatgttaacacagggtcttttcttttggactagtcagatttatcagatactaaattcctaatctcatacctggaagtagaaactggctgccagcattttggaagtcaaytgggagaagagcaggttctcaaattcaagtaatgcccctcttttcaatatgatatccccatcctcttaccttcatgttgccccttcgttcagagaataaaccgcacaactctgttacactgagggaggggtaatcatccagccattccaagtgggggaaggaacagaggatgtaactctgtgctctctgatacagtaaccactagccactgtagctatgtactttacataaatttacataaattaagtaaaatttaaaattcagttcctcagttgcagtaaggaaatagccacgtttcaagtgctcaataaccacatgtggctggtagctattgtatcggacagtgcagaaatagagtgtcttcatcattgccaaaagttctgttcaacaatgcaggtcgaattgcttctcaaatagtcttttcaaccaatgcttatgtttcagtcctacattcactgccacttccagaaatatctggtatcaccaattcatgagcccac

SEQ ID NO: 136 - DNA, 1001 bp, Homo Sapiens
  allele 501: 12-731-119 : polymorphic base C or T
  misc_binding 481..500: 12-731-119.mis1, potential
  misc_binding 502..521: 12-731-119.mis2, potential complement
  primer_bind 383..403: upstream amplification primer
  primer_bind 839..859: downstream amplification primer, complement
  misc_binding 489..513: 12-731-119 potential probe
gcctccacgcctggccttctgattatttctttattatagcattctattcttgctttgtggatgcaaaatcatctcttatcttactttaatttttttcttctctctgaattctctctattttctcaaatttatttttttgtttcttttcttaggtgtttgtatttcctttcagagtgaagatatcctcaaatgtctagtgatccttaactgtctgttcacatttaagactacagcactaaaaatctgattggaagttctgatatatgagttgggttgccaactctgggtcttaccccaggtaatctggctggattgtttcataggacaactcccaatgttaacacagggtcttttcttttggactagtcagatttatcagatactaaattcctaatctcatacctggaagtagaaactggctgccagcattttggaagtcaattgggagaagagcaggttctcaaattcaagtaatgcccctcttttcaatatgatatcccyatcctcttaccttcatgttgccccttcgttcagagaataaaccgcacaactctgttacactgagggaggggtaatcatccagccattccaagtgggggaaggaacagaggatgtaactctgtgctctctgatacagtaaccactagccactgtagctatgtactttacataaatttacataaattaagtaaaatttaaaattcagttcctcagttgcagtaaggaaatagccacgtttcaagtgctcaataaccacatgtggctggtagctattgtatcggacagtgcagaaatagagtgtcttcatcattgccaaaagttctgttcaacaatgcaggtcgaattgcttctcaaatagtcttttcaaccaatgcttatgtttcagtcctacattcactgccacttccagaaatatctggtatcaccaattcatgagcccactggaggttttgaggtgcaagtctggatgatgtattggcttttcctgccagaatagaaac

SEQ ID NO: 137 - DNA, 1001 bp, Homo Sapiens
  allele 501: 12-731-137 : polymorphic base G or T
  misc_binding 481..500: 12-731-137.mis1, potential
  misc_binding 502..521: 12-731-137.mis2, potential complement
  primer_bind 365..385: upstream amplification primer
  primer_bind 821..841: downstream amplification primer, complement
  misc_binding 489..513: 12-731-137 potential probe
ctgattatttctttattatagcattctattcttgctttgtggatgcaaaatcatctcttatcttactttaatttttttcttctctctgaattctctctattttctcaaatttatttttttgtttcttttcttaggtgtttgtatttcctttcagagtgaagatatcctcaaatgtctagtgatccttaactgtctgttcacatttaagactacagcactaaaaatctgattggaagttctgatatatgagttgggttgccaactctgggtcttaccccaggtaatctggctggattgtttcataggacaactcccaatgttaacacagggtcttttcttttggactagtcagatttatcagatactaaattcctaatctcatacctggaagtagaaactggctgccagcattttggaagtcaattgggagaagagcaggttctcaaattcaagtaatgcccctcttttcaatatgatatccccatcctcttaccttcatgktgccccttcgttcagagaataaaccgcacaactctgttacactgagggaggggtaatcatccagccattccaagtgggggaaggaacagaggatgtaactctgtgctctctgatacagtaaccactagccactgtagctatgtactttacataaatttacataaattaagtaaaatttaaaattcagttcctcagttgcagtaaggaaatagccacgtttcaagtgctcaataaccacatgtggctggtagctattgtatcggacagtgcagaaatagagtgtcttcatcattgccaaaagttctgttcaacaatgcaggtcgaattgcttctcaaatagtcttttcaaccaatgcttatgtttcagtcctacattcactgccacttccagaaatatctggtatcaccaattcatgagcccactggaggttttgaggtgcaagtctggatgatgtattggcttttcctgccagaatagaaactccacaaaaacagtgatc

SEQ ID NO: 138 - DNA, 1001 bp, Homo Sapiens
  allele 501: 12-731-146 : polymorphic base A or C
  misc_binding 481..500: 12-731-146.mis1, potential
  misc_binding 502..521: 12-731-146.mis2, potential complement
  primer_bind 356..376: upstream amplification primer
  primer_bind 812..832: downstream amplification primer, complement
  misc_binding 489..513: 12-731-146 potential probe
tctttattatagcattctattcttgctttgtggatgcaaaatcatctcttatcttactttaatttttttcttctctctgaattctctctattttctcaaatttatttttttgtttcttttcttaggtgtttgtatttcctttcagagtgaagatatcctcaaatgtctagtgatccttaactgtctgttcacatttaagactacagcactaaaaatctgattggaagttctgatatatgagttgggttgccaactctgggtcttaccccaggtaatctggctggattgtttcataggacaactcccaatgttaacacagggtcttttcttttggactagtcagatttatcagatactaaattcctaatctcatacctggaagtagaaactggctgccagcattttggaagtcaattgggagaagagcaggttctcaaattcaagtaatgcccctcttttcaatatgatatccccatcctcttaccttcatgttgccccttmgttcagagaataaaccgcacaactctgttacactgagggaggggtaatcatccagccattccaagtgggggaaggaacagaggatgtaactctgtgctctctgatacagtaaccactagccactgtagctatgtactttacataaatttacataaattaagtaaaatttaaaattcagttcctcagttgcagtaaggaaatagccacgtttcaagtgctcaataaccacatgtggctggtagctattgtatcggacagtgcagaaatagagtgtcttcatcattgccaaaagttctgttcaacaatgcaggtcgaattgcttctcaaatagtcttttcaaccaatgcttatgtttcagtcctacattcactgccacttccagaaatatctggtatcaccaattcatgagcccactggaggttttgaggtgcaagtctggatgatgtattggcttttcctgccagaatagaaactccacaaaaacagtgatcttggttttg

SEQ ID NO: 139 - DNA, 1001 bp, Homo Sapiens
  allele 501: 12-731-398 : polymorphic base C or T
  misc_binding 481..500: 12-731-398.mis1, potential
  misc_binding 502..521: 12-731-398.mis2, potential complement
  primer_bind 104..124: upstream amplification primer
  primer_bind 560..580: downstream amplification primer, complement
  misc_binding 489..513: 12-731-398 potential probe
actctgggtcttaccccaggtaatctggctggattgtttcataggacaactcccaatgttaacacagggtcttttcttttggactagtcagatttatcagatactaaattcctaatctcatacctggaagtagaaactggctgccagcattttggaagtcaattgggagaagagcaggttctcaaattcaagtaatgcccctcttttcaatatgatatccccatcctcttaccttcatgttgccccttcgttcagagaataaaccgcacaactctgttacactgagggaggggtaatcatccagccattccaagtgggggaaggaacagaggatgtaactctgtgctctctgatacagtaaccactagccactgtagctatgtactttacataaatttacataaattaagtaaaatttaaaattcagttcctcagttgcagtaaggaaatagccacgtttcaagtgctcaataaccacatgtggctggtagctattgtatyggacagtgcagaaatagagtgtcttcatcattgccaaaagttctgttcaacaatgcaggtcgaattgcttctcaaatagtcttttcaaccaatgcttatgtttcagtcctacattcactgccacttccagaaatatctggtatcaccaattcatgagcccactggaggttttgaggtgcaagtctggatgatgtattggcttttcctgccagaatagaaactccacaaaaacagtgatcttggttttgttcattgatgaaatccaaggacttagaagagtgcctggcacatggtaggtactccatgaatgtttgcggaatgttgaatgaatggcttatttgagaaccaaatgaaatctacagcttaagggattccatccgtaaggggtctgtagtgaataattgtcattcatgtcagctgcccatatctgaacccttttactattcctggggagctccacgcctggggagtcagagccttctccaccaaaggaagagata

SEQ ID NO: 140 - DNA, 1001 bp, Homo Sapiens
  allele 501: 12-732-113 : polymorphic base A or G
  misc_binding 481..500: 12-732-113.mis1, potential
  misc_binding 502..521: 12-732-113.mis2, potential complement
  primer_bind 389..408: upstream amplification primer
  primer_bind 879..898: downstream amplification primer, complement
  misc_binding 489..513: 12-732-113 potential probe
tataagttacccagtctcaggtatttctttatagcaatatgggaagggactaatacagggtgtgaaaaaaggatattgagaccttgggtgaagaaacgtttgcatttactctaaatactgggaactaataaaagaaactgagaagttaagaagctctagtgagcagatcaaagtaaaatgattttccccgatccccatccagccatagattcaataaaatctctgaagaattggggtgcagaaagattgaggacgttggggaggaaggaaggttctaacgataaggcccatgacttctttacacacttgcatacacacacagttgcacacatattcatttccccatgctatcaggacacatggccatctatctacaagagaattttctttttaccaggcaccccactccctcaaagaaagcctgcatcgaaacatctcccacttctgcccattgtggaaagactatttttttgttgttgtttgtttgagttcttgaatgtrctacagtgcaggtgtacttcaggaaaaaggaacatgccagcatttatgggagagggggaggagagggtattaaacaagcatggaacactaaaccagataaatttcacccatgacctagttgtgcctggggccagcccagaacacagtaatgctgttaccaaagaactctgcataagtcatgtcctttaatgattgcagtaaacctctgttaactgcattattcctattttacagaccaggaaacaagctcaagtgtggttaagtccagaacttggccatgatcagcaagtaagaggaagaagcaggactcaaacccagacagcctgtcaactggccaccaagcataattatcatgcctgcttggtttcacatcctcagaggtcaagatgttcatacccacagagaacgggagagaacaccaggtgcatccagataaatcaagacaatggggaacagaagatatttccagtgctctaggaaataaatattttcacctaacc

SEQ ID NO: 141 - DNA, 1001 bp, Homo Sapiens
  allele 501: 12-732-164 : polymorphic base A or G
  misc_binding 481..500: 12-732-164.mis1, potential
  misc_binding 502..521: 12-732-164.mis2, potential complement
  primer_bind 338..357: upstream amplification primer
  primer_bind 828..847: downstream amplification primer, complement
  misc_binding 489..513: 12-732-164 potential probe
aatacagggtgtgaaaaaaggatattgagaccttgggtgaagaaacgtttgcatttactctaaatactgggaactaataaaagaaactgagaagttaagaagctctagtgagcagatcaaagtaaaatgattttccccgatccccatccagccatagattcaataaaatctctgaagaattggggtgcagaaagattgaggacgttggggaggaaggaaggttctaacgataaggcccatgacttctttacacacttgcatacacacacagttgcacacatattcatttccccatgctatcaggacacatggccatctatctacaagagaattttctttttaccaggcaccccactccctcaaagaaagcctgcatcgaaacatctcccacttctgcccattgtggaaagactatttttttgttgttgtttgtttgagttcttgaatgtactacagtgcaggtgtacttcaggaaaaaggaacatgccagcatttatgggrgagggggaggagagggtattaaacaagcatggaacactaaaccagataaatttcacccatgacctagttgtgcctggggccagcccagaacacagtaatgctgttaccaaagaactctgcataagtcatgtcctttaatgattgcagtaaacctctgttaactgcattattcctattttacagaccaggaaacaagctcaagtgtggttaagtccagaacttggccatgatcagcaagtaagaggaagaagcaggactcaaacccagacagcctgtcaactggccaccaagcataattatcatgcctgcttggtttcacatcctcagaggtcaagatgttcatacccacagagaacgggagagaacaccaggtgcatccagataaatcaagacaatggggaacagaagatatttccagtgctctaggaaataaatattttcacctaacctaaacactgagtcgcaatggtgaagaatgttgggagtgggggattaactca

SEQ ID NO: 142 - DNA, 1001 bp, Homo Sapiens
  allele 501: 12-732-165 : polymorphic base G or C
  misc_binding 481..500: 12-732-165.mis1, potential
  misc_binding 502..520: 12-732-165.mis2, complement
  primer_bind 337..356: upstream amplification primer
  primer_bind 827..846: downstream amplification primer, complement
  misc_binding 489..513: 12-732-165 potential probe
atacagggtgtgaaaaaaggatattgagaccttgggtgaagaaacgtttgcatttactctaaatactgggaactaataaaagaaactgagaagttaagaagctctagtgagcagatcaaagtaaaatgattttccccgatccccatccagccatagattcaataaaatctctgaagaattggggtgcagaaagattgaggacgttggggaggaaggaaggttctaacgataaggcccatgacttctttacacacttgcatacacacacagttgcacacatattcatttccccatgctatcaggacacatggccatctatctacaagagaattttctttttaccaggcaccccactccctcaaagaaagcctgcatcgaaacatctcccacttctgcccattgtggaaagactatttttttgttgttgtttgtttgagttcttgaatgtactacagtgcaggtgtacttcaggaaaaaggaacatgccagcatttatgggasagggggaggagagggtattaaacaagcatggaacactaaaccagataaatttcacccatgacctagttgtgcctggggccagcccagaacacagtaatgctgttaccaaagaactctgcataagtcatgtcctttaatgattgcagtaaacctctgttaactgcattattcctattttacagaccaggaaacaagctcaagtgtggttaagtccagaacttggccatgatcagcaagtaagaggaagaagcaggactcaaacccagacagcctgtcaactggccaccaagcataattatcatgcctgcttggtttcacatcctcagaggtcaagatgttcatacccacagagaacgggagagaacaccaggtgcatccagataaatcaagacaatggggaacagaagatatttccagtgctctaggaaataaatattttcacctaacctaaacactgagtcgcaatggtgaagaatgttgggagtgggggattaactcag

SEQ ID NO: 143 - DNA, 1001 bp, Homo Sapiens
  allele 501: 12-732-445 : polymorphic base C or T
  misc_binding 481..500: 12-732-445.mis1, potential
  misc_binding 502..521: 12-732-445.mis2, potential complement
  primer_bind 57..76: upstream amplification primer
  primer_bind 547..566: downstream amplification primer, complement
  misc_binding 489..513: 12-732-445 potential probe
attcatttccccatgctatcaggacacatggccatctatctacaagagaattttctttttaccaggcaccccactccctcaaagaaagcctgcatcgaaacatctcccacttctgcccattgtggaaagactatttttttgttgttgtttgtttgagttcttgaatgtactacagtgcaggtgtacttcaggaaaaaggaacatgccagcatttatgggagagggggaggagagggtattaaacaagcatggaacactaaaccagataaatttcacccatgacctagttgtgcctggggccagcccagaacacagtaatgctgttaccaaagaactctgcataagtcatgtcctttaatgattgcagtaaacctctgttaactgcattattcctattttacagaccaggaaacaagctcaagtgtggttaagtccagaacttggccatgatcagcaagtaagaggaagaagcaggactcaaacccagacagcctgtcaacyggccaccaagcataattatcatgcctgcttggtttcacatcctcagaggtcaagatgttcatacccacagagaacgggagagaacaccaggtgcatccagataaatcaagacaatggggaacagaagatatttccagtgctctaggaaataaatattttcacctaacctaaacactgagtcgcaatggtgaagaatgttgggagtgggggattaactcagaggaaaacttccaagccatcagtagtcaaactttaggagccagactctcctgggaacagggcatatttgagaagccatctgttctcagaactaaagagcatacagggacagaaataggtcaagcatcaactagatttactggaatcaatactaagctttggagctcaaaaatatcagtcaatagaatcaatgaccttccctgtcattggtccatttttcacactgctgataaagacataccagagactgggcatcacaaaagtgagaggtgtattggatt

SEQ ID NO: 144 - DNA, 1001 bp, Homo Sapiens
  allele 501: 12-734-201 : polymorphic base T or C
  misc_binding 481..500: 12-734-201.mis1, potential
  misc_binding 502..521: 12-734-201.mis2, potential complement
  primer_bind 682..701: upstream amplification primer, complement
  primer_bind 301..320: downstream amplification primer
  misc_binding 489..513: 12-734-201 potential probe
gttatgtcttttttagacataatgctattacacacttaatataatataatcacacttttatatgcattgggaaaccaaattgtgtgacttgcattattgctatatttgctttattgtgatggtctggaaccgaaccagtagtatctccgaggtatgcctgtatatggaattgtgggcaattgctccttttcctttcttgggctttcagtatattctgtatttctgtattttgcaaattttctatgatgacttgtattactttcatagtggaaggcagtaaacttaattaaaaacaaaaatgaagtcattagttggaaaggataacaacccttttgttccttcctccttctccttgatattattagatactggataactaaaaccacttaaaaatgagctaattaagatcttaccttctttttttagaatgccttttgccttaagtgtaattaagaagcttacaccacaccttggccccactcccacctctaacccttcatygggaagagacaatactaagtagttggtgtttccttgacatcaaaggacacggtataaacctcaagtattgatagaaacaaaagccagaggaccatgtgacgatgactggccctctttctctcctagacgggggtagccgtgtgtacacacgtgtgtgtgagtgtgccgggacgctacccactccatgtaatgttccattgatttccctgtggtctgtgtgctctcaggaagaagagctgggagcaggccaccttggaggaggcttaatcagctgctgtcgggtacacggatggtgcacaggagcaggcctggagtgggatgatggcgaggagggtagagctggtcagagacctgtttgggggcactgcttgccatggccagggcatggctgcaggagtcacgaaggctgttctcacagacgaactgtcagtcacacctgctcttcttggtgtgagctaaagctcctcacttgcagccctctgttagaggagagaggctac

SEQ ID NO: 145 - DNA, 1001 bp, Homo Sapiens
  allele 501: 12-735-42 : polymorphic base G or A
  misc_binding 481..500: 12-735-42.mis1, potential
  misc_binding 502..521: 12-735-42.mis2, potential complement
  primer_bind 524..542: upstream amplification primer, complement
  primer_bind 10..30: downstream amplification primer
  misc_binding 489..513: 12-735-42 potential probe
  misc_feature 712,716,719: n=a, g, c or t
tagtcaggtggttcaaatatcaaagagcactaaagtgcatagtctgaaaagcctccctgccatccatatacccatctacacagttcccatccttctccaacgaacaaccactattgttagtttctggtttatccttccagagactttaaatatatatatacaagcacagtatatgatttccttcctctattttatccaaaatattatgctattattcaccttccttttattacctaacagtgaaacatatcttagagatcttttaaaatcctaatataaacgatatgttatatggcacttacactacttgtgaaagtatttactagtagaatgagaacgacattctcattcttttttacagttgcatagtattgttttgtaggaagttatcataagtattaagcagtcccctatggatagatgtccaagttttccaatcttctgacaaacaactctgcaataagttatctattacataaattatacaaatgcataggtatrtctataaggtaaattgctagatgttgaagtgctgcataaaagggaatatttttaattgtcattccattgccaaattgccctccagaggattttcaccaatttatactcccacaagcaatttatgaaagtgatcatttctctacatccttgcccaggacgtgttagcaaacttttagcctttgcctaagtggttaaaaaaaaaaaaaaaaanaaanaanaaggattactacagtgcagttttaatttacctgtctcttctattatgtgcaaggtggagcatctttgcatgtatttaagttttatctgtggctccttttggtaaactttctaataagtattttgttattgacatttaggatctctttatattctaaagaagatagttctttgcaataggagcttaaaatatttttcccaatttatcatctttcttttgatattgctttttggggggagtgggaggagacagagtcttgctctgtgacctaggctggagtaca

SEQ ID NO: 146 - DNA, 1001 bp, Homo Sapiens
  allele 501: 12-736-363 : polymorphic base G or A
  misc_binding 481..500: 12-736-363.mis1, potential
  misc_binding 502..521: 12-736-363.mis2, potential complement
  primer_bind 844..862: upstream amplification primer, complement
  primer_bind 386..406: downstream amplification primer
  misc_binding 489..513: 12-736-363 potential probe
  misc_feature 197: n=a, g, c or t
acttcatcacacctgtctctataattgacagatccagcatgtagaaaattagtaaagatagagtgaacagaatagcaccatcaatatgaattgacatttagaggatagtttatctaacaacagaatatatagtctcaacctagagcatacaaaaagatgaccacattttggatcataaaatacacctgtttcaaagnctggcctttgggattggatccactcaggacaagaccaaggatcacatccttctcaggcagccagtgtgacaattctacagagcattttaagcaaagcaaactaaattcatcattaagtaagatataggaaaactccaattaaacaaagtgcttcagaaataggttgtccttagatgtccaagactacaggattaaataaatgatgggacatccaaatagtgcaatacacaagagttattaaaaatcatgttcaagaatgtaattaacattggaaatgctgttatgtaaaatcttatatgaaaarctgatcaaaaaaagtaggaacaattttttaacctataatacagatgagaaaaagacatcaaaaagctatcaagattatttctgtataattttttcttcttttctaaattttctcaactttgtacaataaacatttattactttgatgtgagaaaaatattgtgattggaaattgattaacctgtttaattatattttttaatgaatgaaaaattaagtaaaatacttttggatggtttaagtattttagtgcatactgtgaactaaagcacaacacaaacccagtggtctgattatattcagtgaaatcagtcaatcaaccaaccaatccagaaaagcacccctggcatatttaagcctattaaaaacaaaaacaaaaccacttgtaaatttaagacaaatgaaaaaaattgcatcttttcttcttatgtaagcatctcatagggcctacagcttataaagcaaaacatcattaatcatcaccatagaaccacgaatgca

SEQ ID NO: 147 - DNA, 1001 bp, Homo Sapiens
  allele 501: 12-737-69 : polymorphic base T or C
  misc_binding 502..521: 12-737-69.mis1, potential complement
  misc_binding 482..500: 12-737-69.mis2
  primer_bind 547..566: upstream amplification primer, complement
  primer_bind 47..67: downstream amplification primer
  misc_binding 489..513: 12-737-69 potential probe
acctcaatacgtatacattgccttggttccaaagagtaattggaatgggcttactactttctagtggatttatagaaaaagccatctgataaaaatatatttactatgatgcccattataacatctgaggttaagaatactttgtattctacaaacatttgaaagccagaggtcacgtaaaacaaatgcaggtttaatacaaatgcacaaaattacacataaacagagaacgctacagagagagagataaccttggataacttggctctttccttccctattctctttctggaggtaatcgtatacattcccatggcttttatacactaaagcttttagacagcaagtagatgacaaactcactttaataatcagttatcataagcttggtattggggttaaaaataaactcttgacaaaggactcctttattcttaaatcccttttattgtcaaggactcctttattctaatgcagtggctcctgaaaaactttcctttycaaggatacttttccaaacacaatcaataatctacaatcaactttgtaatctctttagaagccaggaccttctcagctttggagttttgatgataaaatgcatagctggatttctacaagcccaagatctaaaaactgtatttgttggttattaatcagattattaataatctggtgtttgagacatactgtgaagtcaacagttataaaaattattaattttagaaattcagagttataatgggtctaaaaatatagttagaatgaatgaataaggcctagcatttgatagcataaaagggtgactgtagtcaataataattcaattgtatattttaaaataactggaagaatatagctggattgtttgtaacacaaaggataaatgcttgacaggatggatacttcatcttccgtgatgtgattattacatgctgcagaacatctcatgtaacccattaatatatacgcctattatgtacccacaaaaattaaaaatt

SEQ ID NO: 148 - DNA, 1001 bp, Homo Sapiens
  allele 501: 12-737-296 : polymorphic base G or A
  misc_binding 481..500: 12-737-296.mis1, potential
  misc_binding 502..521: 12-737-296.mis2, potential complement
  primer_bind 768..787: upstream amplification primer, complement
  primer_bind 268..288: downstream amplification primer
  misc_binding 489..513: 12-737-296 potential probe
ctaggtactctatttagtgcttggaatatagagatgaaagactgaagtagtgttagaaatgaaaaatcattgttaaattctttctcttctaatacgattatctatgctgctaagcaattttctcagtgatcatcagccatcagccatcaaaacccgggaccttccccacagctcctcttttaaccctaatatttaaccaaaaattgctctgctgcggcaaaacctcaatacgtatacattgccttggttccaaagagtaattggaatgggcttactactttctagtggatttatagaaaaagccatctgataaaaatatatttactatgatgcccattataacatctgaggttaagaatactttgtattctacaaacatttgaaagccagaggtcacgtaaaacaaatgcaggtttaatacaaatgcacaaaattacacataaacagagaacgctacagagagagagataaccttggataacttggctctttccttccctrttctctttctggaggtaatcgtatacattcccatggcttttatacactaaagcttttagacagcaagtagatgacaaactcactttaataatcagttatcataagcttggtattggggttaaaaataaactcttgacaaaggactcctttattcttaaatcccttttattgtcaaggactcctttattctaatgcagtggctcctgaaaaactttccttttcaaggatacttttccaaacacaatcaataatctacaatcaactttgtaatctctttagaagccaggaccttctcagctttggagttttgatgataaaatgcatagctggatttctacaagcccaagatctaaaaactgtatttgttggttattaatcagattattaataatctggtgtttgagacatactgtgaagtcaacagttataaaaattattaattttagaaattcagagttataatgggtctaaaaatatagttagaatgaatgaataaggcc

SEQ ID NO: 149 - DNA, 1001 bp, Homo Sapiens
  allele 501: 12-738-429 : polymorphic base G or A
  misc_binding 502..520: 12-738-429.mis1, complement
  misc_binding 481..500: 12-738-429.mis2, potential
  primer_bind 903..922: upstream amplification primer, complement
  primer_bind 478..498: downstream amplification primer
  misc_binding 489..513: 12-738-429 potential probe
agagtcttctaaaatgaaatataatcacaagagtagtattgcatcaccgtctccatactctgtggcctagaaataagtcaggggtcctgcccacacccaaggggagtgaatatacaaaagcataaacaccaaggggcaggaatcatggagaccaccttaaagtttgtccaccacaactagaaacctaaaaaatatgtttatgtctattaagaacacatgggcacagggaggggcacatcacacaccagggcctgtcagggggtgggggggcaaggggtgggatagcattaggagaagtacctaacatagatgacacattgataggtgcagcaaaccaccatggcacatgtatacctatgtaacaaacctgcacattctccacatgtatcccagaacttaaagtaaaatttatatatatatatcctgcttttcccaaattttaccagtggagaatcactctccatcatgttctagaattgcattcacacttaggagaactcrcattcactggctaattctatattgcgtgctattttaagatcttttcaggaaggaaacttctgccatcagttggccaatgctgttccatcagtgagtattcagtgtcactaaccaacagaatgaccaagaaatcattccagtcagaaaaggcccaagtaccaacgattggacagtcgtgatttatatttgtgcctgatatgaccaacataagtcacactggttatgcatggaaatgcaaccatcagctgacaagaactgaaacttatgactcatgctgtgtcaactctgagccaaagcagtcagtcaactcaaagggagtaaacatcagtcaaacagatgatttggcagcctaactatttaacaactgatgatgactggaattttcacttttccatcagtcacatagacttgtctcaggaagagaaataactgaagtttagagtagttttcttttgctttttcataaaagtcattcatcccaaaacatttgctgaatgcct

SEQ ID NO: 150 - DNA, 1001 bp, Homo Sapiens
  allele 501: 12-740-112 : polymorphic base A or G
  misc_binding 482..500: 12-740-112.mis1
  misc_binding 502..521: 12-740-112.mis2, potential complement
  primer_bind 391..410: upstream amplification primer
  primer_bind 828..846: downstream amplification primer, complement
  misc_binding 489..513: 12-740-112 potential probe
ttattcattaccatgagaactgtatgggggaaaccacccccatgattcaattttctcccaccaggtccctcccacaacacatgggaattatgggcatacaattcaagatgagatttgggtggggacacagctaaaccatatcattccccaaacctgctttcttccatgattgggaatagaaagaatgttcaagtaggatctagaagattgagttcaaattcttgttcacttgttttctggctgtgtgtttttaagcatgtagctaaacctctctgagacacaaatgtggcaactaaaaatcaaaagttttttaaagtactagacatcagaacactggtccaaatcactatatgtgttcaagtcacagctgagccgtgtgtcaaatggggatcataatgccccccttccagggatgctgcaaatgggcaaacacatgcagaggtgccaggttaactatgaaggctacttaaaatgatcacacttgcctccaccaaaaaaagrgggaacctaaccaggaggtccttcaaaattcctcttggttaagctttggtcaatgatcctttggtgaaaagagctaataaactgcttactaggtgacaagaagggccagcttcatggggcacaacctgtgcggtcacacagggccctgctgtctctatcttcagattcatactaatgtttgaacaaggagccccacattttcatcttgcactgagtcctgcaaatcatgtagcagggcccggtgcatggcactgtgcttagcatccagaacacagcaataaaacagattggcatctttgaggagctccaagcaagtagattactttgggagcaaatcctacaaagcaaacaggacacttacagaaataaattaacttgcatattttattcctcagtccaatcttagactgaaagctccaaagactaaagcagttatttatccttaggacaagccctggcttgtttgcacatgaaacacacctgaatacctacagactcac

SEQ ID NO: 151 - DNA, 1001 bp, Homo Sapiens
  allele 501: 12-740-118 : polymorphic base C or T
  misc_binding 481..500: 12-740-118.mis1, potential
  misc_binding 502..521: 12-740-118.mis2, potential complement
  primer_bind 385..404: upstream amplification primer
  primer_bind 822..840: downstream amplification primer, complement
  misc_binding 489..513: 12-740-118 potential probe
attaccatgagaactgtatgggggaaaccacccccatgattcaattttctcccaccaggtccctcccacaacacatgggaattatgggcatacaattcaagatgagatttgggtggggacacagctaaaccatatcattccccaaacctgctttcttccatgattgggaatagaaagaatgttcaagtaggatctagaagattgagttcaaattcttgttcacttgttttctggctgtgtgtttttaagcatgtagctaaacctctctgagacacaaatgtggcaactaaaaatcaaaagttttttaaagtactagacatcagaacactggtccaaatcactatatgtgttcaagtcacagctgagccgtgtgtcaaatggggatcataatgccccccttccagggatgctgcaaatgggcaaacacatgcagaggtgccaggttaactatgaaggctacttaaaatgatcacacttgcctccaccaaaaaaagagggaayctaaccaggaggtccttcaaaattcctcttggttaagctttggtcaatgatcctttggtgaaaagagctaataaactgcttactaggtgacaagaagggccagcttcatggggcacaacctgtgcggtcacacagggccctgctgtctctatcttcagattcatactaatgtttgaacaaggagccccacattttcatcttgcactgagtcctgcaaatcatgtagcagggcccggtgcatggcactgtgcttagcatccagaacacagcaataaaacagattggcatctttgaggagctccaagcaagtagattactttgggagcaaatcctacaaagcaaacaggacacttacagaaataaattaacttgcatattttattcctcagtccaatcttagactgaaagctccaaagactaaagcagttatttatccttaggacaagccctggcttgtttgcacatgaaacacacctgaatacctacagactcacccagcc

SEQ ID NO: 152 - DNA, 1001 bp, Homo Sapiens
  allele 501: 12-741-265 : polymorphic base G or A
  misc_binding 481..500: 12-741-265.mis1, potential
  misc_binding 502..521: 12-741-265.mis2, potential complement
  primer_bind 745..765: upstream amplification primer, complement
  primer_bind 316..336: downstream amplification primer
  misc_binding 489..513: 12-741-265 potential probe
agcgtaaagaaacactttcactgctgataataatggttaatttatcacatccagccgaggctgacctctgggcgtcccagcccctccatcaccttcacacctgctcaagctaattgttagagccaagtgtaaatgaaaatcaactgggctaataatgaatggagcccattacttccaaaagcacattgctttacaaaggtttatcaagaaacattataaccagttccccccaccccctgcgcccccccatcccccgtcacagttccctattttatagatgagaaaaaagtgagcaaacaaggagggaccagcctatgaaaacaggcacaagcacagagactggaaacacatttgactttggcttcctgagctctacaacagctattcctgtgtgttaccaaaattcactcaatgtatcgaaagagtgaggtttacaatatttatcccaatgttgttgtcatctgtttatataagtaaatgagatcattactggatgtgaaraccttaattaatatgctaatctcattcctccaccaaaaccattttttaaggtggccatcttcatgtcttccccagtcactgtcacctcccctagaactgccttgccattctcatctgaaagcacagacccagttcccaaatcactgatatgacataaccagaactcctgttaaagacaactgagtgtcttcaaggggcagctattagattgtcaggaattatcagctgtagttagaagatatagccctaagggggtttgagaaatcccttcccatcaccaaattgggggtttaatgtgtctgggaacatttttaaacttttttgtattgtaatatatttgttcatttttaatttatttacagtacaagcagttcacatccccatctcaagccataaatcaaaaagattattgatctcccagcacattcactgataaaaggaaataccagcaactccatgcatctgagcatacaacttatatggacttctagcaagtgatc

SEQ ID NO: 153 - DNA, 1001 bp, Homo Sapiens
  allele 501: 12-741-327 : polymorphic base T or A
  misc_binding 481..500: 12-741-327.mis1, potential
  misc_binding 502..521: 12-741-327.mis2, potential complement
  primer_bind 807..827: upstream amplification primer, complement
  primer_bind 378..398: downstream amplification primer
  misc_binding 489..513: 12-741-327 potential probe
caaacccagctctgaacagtgagtttatgtgagatatgttgtccctttgtttgctcctgacaagcgtaaagaaacactttcactgctgataataatggttaatttatcacatccagccgaggctgacctctgggcgtcccagcccctccatcaccttcacacctgctcaagctaattgttagagccaagtgtaaatgaaaatcaactgggctaataatgaatggagcccattacttccaaaagcacattgctttacaaaggtttatcaagaaacattataaccagttccccccaccccctgcgcccccccatcccccgtcacagttccctattttatagatgagaaaaaagtgagcaaacaaggagggaccagcctatgaaaacaggcacaagcacagagactggaaacacatttgactttggcttcctgagctctacaacagctattcctgtgtgttaccaaaattcactcaatgtatcgaaagagtgaggtttacaatwtttatcccaatgttgttgtcatctgtttatataagtaaatgagatcattactggatgtgaagaccttaattaatatgctaatctcattcctccaccaaaaccattttttaaggtggccatcttcatgtcttccccagtcactgtcacctcccctagaactgccttgccattctcatctgaaagcacagacccagttcccaaatcactgatatgacataaccagaactcctgttaaagacaactgagtgtcttcaaggggcagctattagattgtcaggaattatcagctgtagttagaagatatagccctaagggggtttgagaaatcccttcccatcaccaaattgggggtttaatgtgtctgggaacatttttaaacttttttgtattgtaatatatttgttcatttttaatttatttacagtacaagcagttcacatccccatctcaagccataaatcaaaaagattattgatctcccagcacattcactgataaaa

SEQ ID NO: 154 - DNA, 1001 bp, Homo Sapiens
  allele 501: 12-741-376 : polymorphic base G or A
  misc_binding 481..500: 12-741-376.mis1, potential
  misc_binding 502..521: 12-741-376.mis2, potential complement
  primer_bind 856..876: upstream amplification primer, complement
  primer_bind 427..447: downstream amplification primer
  misc_binding 489..513: 12-741-376 potential probe
ctccctcccatctgcctatagggccacaaaggaaactcttatccttcatcaaacccagctctgaacagtgagtttatgtgagatatgttgtccctttgtttgctcctgacaagcgtaaagaaacactttcactgctgataataatggttaatttatcacatccagccgaggctgacctctgggcgtcccagcccctccatcaccttcacacctgctcaagctaattgttagagccaagtgtaaatgaaaatcaactgggctaataatgaatggagcccattacttccaaaagcacattgctttacaaaggtttatcaagaaacattataaccagttccccccaccccctgcgcccccccatcccccgtcacagttccctattttatagatgagaaaaaagtgagcaaacaaggagggaccagcctatgaaaacaggcacaagcacagagactggaaacacatttgactttggcttcctgagctctacaacagctattcctrtgtgttaccaaaattcactcaatgtatcgaaagagtgaggtttacaatatttatcccaatgttgttgtcatctgtttatataagtaaatgagatcattactggatgtgaagaccttaattaatatgctaatctcattcctccaccaaaaccattttttaaggtggccatcttcatgtcttccccagtcactgtcacctcccctagaactgccttgccattctcatctgaaagcacagacccagttcccaaatcactgatatgacataaccagaactcctgttaaagacaactgagtgtcttcaaggggcagctattagattgtcaggaattatcagctgtagttagaagatatagccctaagggggtttgagaaatcccttcccatcaccaaattgggggtttaatgtgtctgggaacatttttaaacttttttgtattgtaatatatttgttcatttttaatttatttacagtacaagcagttcacatccccatctcaa

SEQ ID NO: 155 - DNA, 1001 bp, Homo Sapiens
  allele 501: 12-745-30 : polymorphic base G or A
  misc_binding 481..500: 12-745-30.mis1, potential
  misc_binding 502..521: 12-745-30.mis2, potential complement
  primer_bind 512..530: upstream amplification primer, complement
  primer_bind 67..86: downstream amplification primer
  misc_binding 489..513: 12-745-30 potential probe
ttaacctgtttggagaaattatgactacaaatatcttgtatacaacacctctaactaccagcttgtacaaacaacataagagcaggagccgcctcatccagacgattggaaccacttcagaggcgatcatgattagtgctttggctggaagccatattttacacataaactcagcatctgactccgagatgctgtcccaggctaacagacccaccttccctgttactaataagcacattcacgagcgccagatggtctgacgggaagagctctgccttttcctgagctaggcacactggagggaggcagcctgagccggctccaagtcatatttcctcgggctctaggttcctgcaatgctgcgtgcaaacaggcgccactaaaaaagaatgtaaatgagggtgctattcattatttacggctggcaccttgccatcccctcctcctctgggcgatgcctgcctgtaggaacaggaaaagcatctgatgagagcagggccrtcgtggaggagtcaagccattgcgaagcagtttcttacatttcgctgaggatcctgcaggctcagcatttctggcccacgggagagctgagcttttcactttcttcctaacaaagcactagagttccttggcctcatgtctgtaccaagggtgttcatttacagtctaacctgaaaaagctggctagctgctctaatcctattcattgctgaggtccttggccccatgcctgggtttgagcccaggcaaagaagaaagaaaaagaggggttggggggaatgatggtctacacagaggagacttacaagaaagttctagactaaaccggccagaagttgcacccaaagaatagctcacttctttgggtgagtgcctacagatcttatgctatataatgaaatgtttcacaagtttatatcatctctccctaactgatcttaagctacaggagggcataaactatacattatacttattctgaatttcttcaagtgccaatc

SEQ ID NO: 156 - DNA, 1001 bp, Homo Sapiens
  allele 501: 12-745-75 : polymorphic base T or C
  misc_binding 481..500: 12-745-75.mis1, potential
  misc_binding 502..521: 12-745-75.mis2, potential complement
  primer_bind 557..575: upstream amplification primer, complement
  primer_bind 112..131: downstream amplification primer
  misc_binding 489..513: 12-745-75 potential probe
tttgaaacacagcacattaatacgctgattctcataatgtttgccttaacctgtttggagaaattatgactacaaatatcttgtatacaacacctctaactaccagcttgtacaaacaacataagagcaggagccgcctcatccagacgattggaaccacttcagaggcgatcatgattagtgctttggctggaagccatattttacacataaactcagcatctgactccgagatgctgtcccaggctaacagacccaccttccctgttactaataagcacattcacgagcgccagatggtctgacgggaagagctctgccttttcctgagctaggcacactggagggaggcagcctgagccggctccaagtcatatttcctcgggctctaggttcctgcaatgctgcgtgcaaacaggcgccactaaaaaagaatgtaaatgagggtgctattcattatttacggctggcaccttgccatcccctcctcctctgggcgaygcctgcctgtaggaacaggaaaagcatctgatgagagcagggccatcgtggaggagtcaagccattgcgaagcagtttcttacatttcgctgaggatcctgcaggctcagcatttctggcccacgggagagctgagcttttcactttcttcctaacaaagcactagagttccttggcctcatgtctgtaccaagggtgttcatttacagtctaacctgaaaaagctggctagctgctctaatcctattcattgctgaggtccttggccccatgcctgggtttgagcccaggcaaagaagaaagaaaaagaggggttggggggaatgatggtctacacagaggagacttacaagaaagttctagactaaaccggccagaagttgcacccaaagaatagctcacttctttgggtgagtgcctacagatcttatgctatataatgaaatgtttcacaagtttatatcatctctccctaactgatcttaagctacaggagggca

SEQ ID NO: 157 - DNA, 1001 bp, Homo Sapiens
  allele 501: 12-745-343 : polymorphic base T or G
  misc_binding 481..500: 12-745-343.mis1, potential
  misc_binding 502..521: 12-745-343.mis2, potential complement
  primer_bind 825..843: upstream amplification primer, complement
  primer_bind 380..399: downstream amplification primer
  misc_binding 489..513: 12-745-343 potential probe
ggattcccatctgctaaatgatgtttccagaagaaaccctggctcttgagcagcagcaaagggtacatggaaattcagtacaagcaccgatcctctcaaagcagtttttctaagttcccttgcataaagcaggtttttttctccacttaaacaacaacaatttgttttactttgataggtccttctgaataatggtttcatcattaaacatctggcttcttcttagcagattaggcctccaatgaggaaagtgtgtttataattctaatttgaaacacagcacattaatacgctgattctcataatgtttgccttaacctgtttggagaaattatgactacaaatatcttgtatacaacacctctaactaccagcttgtacaaacaacataagagcaggagccgcctcatccagacgattggaaccacttcagaggcgatcatgattagtgctttggctggaagccatattttacacataaactcagcatctgactccgakatgctgtcccaggctaacagacccaccttccctgttactaataagcacattcacgagcgccagatggtctgacgggaagagctctgccttttcctgagctaggcacactggagggaggcagcctgagccggctccaagtcatatttcctcgggctctaggttcctgcaatgctgcgtgcaaacaggcgccactaaaaaagaatgtaaatgagggtgctattcattatttacggctggcaccttgccatcccctcctcctctgggcgatgcctgcctgtaggaacaggaaaagcatctgatgagagcagggccatcgtggaggagtcaagccattgcgaagcagtttcttacatttcgctgaggatcctgcaggctcagcatttctggcccacgggagagctgagcttttcactttcttcctaacaaagcactagagttccttggcctcatgtctgtaccaagggtgttcatttacagtctaacctgaaaaagctggctag

SEQ ID NO: 158 - DNA, 1001 bp, Homo Sapiens
  allele 501: 12-745-350 : polymorphic base C or A
  misc_binding 481..500: 12-745-350.mis1, potential
  misc_binding 502..521: 12-745-350.mis2, potential complement
  primer_bind 832..850: upstream amplification primer, complement
  primer_bind 387..406: downstream amplification primer
  misc_binding 489..513: 12-745-350 potential probe
gaaggccggattcccatctgctaaatgatgtttccagaagaaaccctggctcttgagcagcagcaaagggtacatggaaattcagtacaagcaccgatcctctcaaagcagtttttctaagttcccttgcataaagcaggtttttttctccacttaaacaacaacaatttgttttactttgataggtccttctgaataatggtttcatcattaaacatctggcttcttcttagcagattaggcctccaatgaggaaagtgtgtttataattctaatttgaaacacagcacattaatacgctgattctcataatgtttgccttaacctgtttggagaaattatgactacaaatatcttgtatacaacacctctaactaccagcttgtacaaacaacataagagcaggagccgcctcatccagacgattggaaccacttcagaggcgatcatgattagtgctttggctggaagccatattttacacataaactcagcatctgmctccgagatgctgtcccaggctaacagacccaccttccctgttactaataagcacattcacgagcgccagatggtctgacgggaagagctctgccttttcctgagctaggcacactggagggaggcagcctgagccggctccaagtcatatttcctcgggctctaggttcctgcaatgctgcgtgcaaacaggcgccactaaaaaagaatgtaaatgagggtgctattcattatttacggctggcaccttgccatcccctcctcctctgggcgatgcctgcctgtaggaacaggaaaagcatctgatgagagcagggccatcgtggaggagtcaagccattgcgaagcagtttcttacatttcgctgaggatcctgcaggctcagcatttctggcccacgggagagctgagcttttcactttcttcctaacaaagcactagagttccttggcctcatgtctgtaccaagggtgttcatttacagtctaacctgaaaaagc

SEQ ID NO: 159 - DNA, 1001 bp, Homo Sapiens
  allele 501: 12-746-320 : polymorphic base C or T
  misc_binding 481..500: 12-746-320.mis1, potential
  misc_binding 502..521: 12-746-320.mis2, potential complement
  primer_bind 183..201: upstream amplification primer
  primer_bind 672..692: downstream amplification primer, complement
  misc_binding 489..513: 12-746-320 potential probe
actgtgatcaagaacatgatttttttctccctgccttggtggggctgggcagagccatcatgtttcacaaccccagagaacactcatcctgttgtagtctatgtgaatgatacctcccttggtgttgtgcagtgcacaacctgtgcagccatacatgacagccctgtattgtgacctaggtgtgtgtgagatggtcttttccgccttttgctacagagttgcccttccagttaaaaaagttagaaggcaaatcttattgagaaacaaatgggtgaaccccgaaaggtcttgacttctccatggacttgatcttcagaccagttttactgggctatgcacaaatggctgtatatatgaatcttccccagtatgtgaagttcccatggtataaactattagtaaatatagctacagcagggaaaaccaggctcacaaaatggctacatttagcaagacaaatgatttgaggacagaaatcttttaaatcaatttttagttttyaaatgactcccgtctccagtcctctccctgtgttttgacaaacggctttggcttcttatccacatcggtttatttgacctcctttttccatcaactaccaaaatgaaaactctgctgcaagagcgaggagagagagtgcgagcaattttaaacatcccttagcagtgaggcagaacatgctacagccatcaagttctagttgttcattctatttattgagaaaagcttgtagcccgatttcttttacgcgagtacatttgagcaagcaaagtttatagagatgacttacctcattacattagaagagtgatttgctatctcagcatctataagcaattttaacagacatttctggatgaagaaaagcttttgtaaatatatgcgaaagacacaatttcatcaagcattaaattggaggtgccctggaaaaatattacatttgtgcactcaattagcttgattgtggctgaattttgtccactgaaggcagcatttctgca

SEQ ID NO: 160 - DNA, 1001 bp, Homo Sapiens
  allele 501: 12-747-181 : polymorphic base C or T
  misc_binding 481..500: 12-747-181.mis1, potential
  misc_binding 502..521: 12-747-181.mis2, potential complement
  primer_bind 321..340: upstream amplification primer
  primer_bind 767..787: downstream amplification primer, complement
  misc_binding 489..513: 12-747-181 potential probe
cagttccggggctactttctctgtgaagcctggaaaggcatcacagggcagctttcacagactcccatggctggctcacgggacctcccaatgcttagattaaaccacgtatgctgccatttttgtggtgaacatggttatcataaaagtgattttcttttgatgccagggtccatgtcatgccatctttgaaccaccagtccctcagagtgtcttgtttgtggaaagtgcttttggaatgagggggagctgagtaagactagggacaaggaagctatgagaagaaagatgagcagggatgctgtggggctgcatcctgagattaaggcaaaaggacaagttacctctctataaatgccagtgctgcacctatgtcgtggttccaccctattcaccctgtggtggaggaagctaatggtccagctgtattccttcttctcttcttcctttaataattgaactggagagtttagttgggcatgcggtttcccagccagaggyaacatctctcacattctcttacaagatatggtcaagtggcaaagttctggccaatgggaagtgagaggaagaaatgtgtggcaatttcaggttgtgcccttaaaaggcataacgcacttcttcctggacattttcctgctctacattgcatattctgtagatgtagtggtgggtgttagagatggaaacactcagttgcacatggcagaactgccccactagcctgggcaccagcccattgactgtgaacatggaaggaaagcttccttgtctgacccatagtagtttcagatctctgcagagactgtacctaaacacttatgttaaaaaatcatgaagcatttcaagcacacacaattttgatattttttgtgatatgtacttcatatattttcttttccatttcttttcactttccattttaaactaaataacatgttatgtttgtaacatttttgtgtgttttaaacacaaaaaacatttacaaaaaacagcatact

SEQ ID NO: 161 - DNA, 1001 bp, Homo Sapiens
  allele 501: 12-747-302 : polymorphic base C or T
  misc_binding 481..500: 12-747-302.mis1, potential
  misc_binding 502..521: 12-747-302.mis2, potential complement
  primer_bind 200..219: upstream amplification primer
  primer_bind 646..666: downstream amplification primer, complement
  misc_binding 489..513: 12-747-302 potential probe
tttgtggtgaacatggttatcataaaagtgattttcttttgatgccagggtccatgtcatgccatctttgaaccaccagtccctcagagtgtcttgtttgtggaaagtgcttttggaatgagggggagctgagtaagactagggacaaggaagctatgagaagaaagatgagcagggatgctgtggggctgcatcctgagattaaggcaaaaggacaagttacctctctataaatgccagtgctgcacctatgtcgtggttccaccctattcaccctgtggtggaggaagctaatggtccagctgtattccttcttctcttcttcctttaataattgaactggagagtttagttgggcatgcggtttcccagccagaggcaacatctctcacattctcttacaagatatggtcaagtggcaaagttctggccaatgggaagtgagaggaagaaatgtgtggcaatttcaggttgtgcccttaaaaggcataacgcacttcytcctggacattttcctgctctacattgcatattctgtagatgtagtggtgggtgttagagatggaaacactcagttgcacatggcagaactgccccactagcctgggcaccagcccattgactgtgaacatggaaggaaagcttccttgtctgacccatagtagtttcagatctctgcagagactgtacctaaacacttatgttaaaaaatcatgaagcatttcaagcacacacaattttgatattttttgtgatatgtacttcatatattttcttttccatttcttttcactttccattttaaactaaataacatgttatgtttgtaacatttttgtgtgttttaaacacaaaaaacatttacaaaaaacagcatactttttccagtcactatttggtttttgagatttgtctgttgatttacatatggtgggatcaatattttaactactatgtaccatttcactgaatgaatagaattcaattttatatagaatata

SEQ ID NO: 162 - DNA, 1001 bp, Homo Sapiens
  allele 501: 12-749-240 : polymorphic base A or G
  misc_binding 481..500: 12-749-240.mis1, potential
  misc_binding 502..521: 12-749-240.mis2, potential complement
  primer_bind 262..281: upstream amplification primer
  primer_bind 761..780: downstream amplification primer, complement
  misc_binding 489..513: 12-749-240 potential probe
ttaaccacttttggaaacagatgcttctaaatgtgactaattttcctcaacatttaacagcaacatcagaaattaaacatgttacagcaaccattaggttcagtcccacccctgttcctatcagtgttgtctattagggaaatcatatcctattaacatacttacattaattgaggaaggaagcttgaaggaaagaaaagaactggctatcactaaacactggtatctacttgctggccccattgcccttctgaccaagaaagtgggtggaggaagttgaggctttttaaaataagttttcttagctagaatccttgatccattcccagaagctgtagtacatttctacttcaaatgaaatatcctacttgtaaatgtcttagactattgaataataagaaagcttggagcagctatccaactccaatcctggttttgtctgaacctacaacaaatagccaaggaagaatacagaattacacaaagaacttctcctgatgrctagcttaggcaaggttcaaggtacaagactagacaagtactgactttatcaagcattctcaactagacagttgggtgaaaatcctttccccaaagctctttgttctgatgtctgacttagatgctacaagaatgtgaagtgtttaccaatgctttttctgaaacctttgctccaaagatatgatgatcattaatatgtcctgtcctgccttcttgaggaatgcattaccagtgcttaaatatgaatattgtgcttgtacctcaaaatgacagctcaagaaatgcaaggggactatggtgtcaactgccaatcccaacaagtcatccttccataactggcagcaaatctgcagttgtacaggtctgcagcaacctcaagtcttgcctcctcagaagaaagaatttgtctgaggagcataaggtagaaggagagactgaagcaagttttatagcagaaatgaaagtttattaaagagcattagaggagcaggaacagaagg

SEQ ID NO: 163 - DNA, 1001 bp, Homo Sapiens
  allele 501: 12-749-255 : polymorphic base G or T
  misc_binding 481..500: 12-749-255.mis1, potential
  misc_binding 502..521: 12-749-255.mis2, potential complement
  primer_bind 247..266: upstream amplification primer
  primer_bind 746..765: downstream amplification primer, complement
  misc_binding 489..513: 12-749-255 potential probe
aacagatgcttctaaatgtgactaattttcctcaacatttaacagcaacatcagaaattaaacatgttacagcaaccattaggttcagtcccacccctgttcctatcagtgttgtctattagggaaatcatatcctattaacatacttacattaattgaggaaggaagcttgaaggaaagaaaagaactggctatcactaaacactggtatctacttgctggccccattgcccttctgaccaagaaagtgggtggaggaagttgaggctttttaaaataagttttcttagctagaatccttgatccattcccagaagctgtagtacatttctacttcaaatgaaatatcctacttgtaaatgtcttagactattgaataataagaaagcttggagcagctatccaactccaatcctggttttgtctgaacctacaacaaatagccaaggaagaatacagaattacacaaagaacttctcctgatggctagcttaggcaagkttcaaggtacaagactagacaagtactgactttatcaagcattctcaactagacagttgggtgaaaatcctttccccaaagctctttgttctgatgtctgacttagatgctacaagaatgtgaagtgtttaccaatgctttttctgaaacctttgctccaaagatatgatgatcattaatatgtcctgtcctgccttcttgaggaatgcattaccagtgcttaaatatgaatattgtgcttgtacctcaaaatgacagctcaagaaatgcaaggggactatggtgtcaactgccaatcccaacaagtcatccttccataactggcagcaaatctgcagttgtacaggtctgcagcaacctcaagtcttgcctcctcagaagaaagaatttgtctgaggagcataaggtagaaggagagactgaagcaagttttatagcagaaatgaaagtttattaaagagcattagaggagcaggaacagaaggaaataaagtacacct

SEQ ID NO: 164 - DNA, 1003 bp, Homo Sapiens
  allele 508: 12-752-37 : polymorphic base G or A
  misc_binding 488..507: 12-752-37.mis1, potential
  misc_binding 509..528: 12-752-37.mis2, potential complement
  primer_bind 527..544: upstream amplification primer, complement
  primer_bind 1..21: downstream amplification primer
  misc_binding 496..520: 12-752-37 potential probe
  misc_feature 685: n=a, g, c or t
gaaaaacagaaactcaaacactcaaatttcatattttgctcagttatgtgaacttaacaatgtttacatgtttaaaaaataagagtagtttggtaattaaatgtaatttgatatttatcaatgtccaatattcctttaactttagtctcataaacatactttcctcaataagtttaggataatgtgtctacccaattcttttaaatgtttgtttatattttttcacaactctttaactacttatagacaagaatcagctctatttagcaaacgtctgaaagttggtgaatcagtaatggaaatagctttggtaagttttgatcagtgaagtacataagctatagtctgtactgtcttcctccttttggttaactccctattatgattttctggaccaccaaatatcaaagccacaagtcttaagttaagacttgtcctaaggctgatcccaaagcaacagtccttacgagtcgaactttttagatccttaactttggtgacaacccaraagaaattagaatcaattgtccatgcctttgttgagtgcctcatctatgcttggaacttaagtggattttgcagcaataaagaaaaaacacaaatttctatgtaacgaccctgtaatcttgtcagagagataaaatttgaacggacaaaacaacagtgaaatatctaggacaatatnaaatggcattgtactgtctgtacggacctatagaatttgggaagggagaaagggatttgtttaaggctaaggtactccatgaaggttttgtgaaagattttgacttcatttaagccttaaatgataggcaacagttttcctgggagacagggtttgagagatgtggtagcatggggtggtgaaaagaccataggctttagctctgccacttactgcaggctagacccttgtgcaagttgcttatattcactgagctgcagtctcttcatttcagaaatgaggatccaatccagttgagtgctgtgtgctctggaaggc

SEQ ID NO: 165 - DNA, 1001 bp, Homo Sapiens
  allele 501: 12-752-85 : polymorphic base C or G
  misc_binding 481..500: 12-752-85.mis1, potential
  misc_binding 502..521: 12-752-85.mis2, potential complement
  primer_bind 568..585: upstream amplification primer, complement
  primer_bind 42..62: downstream amplification primer
  misc_binding 489..513: 12-752-85 potential probe
  misc_feature 726: n=a, g, c or t
aattgaatatgtttgtttctaagtgagtgacatgttacctcgaaaaacagaaactcaaacactcaaatttcatattttgctcagttatgtgaacttaacaatgtttacatgtttaaaaaataagagtagtttggtaattaaatgtaatttgatatttatcaatgtccaatattcctttaactttagtctcataaacatactttcctcaataagtttaggataatgtgtctacccaattcttttaaatgtttgtttatattttttcacaactctttaactacttatagacaagaatcagctctatttagcaaacgtctgaaagttggtgaatcagtaatggaaatagctttggtaagttttgatcagtgaagtacataagctatagtctgtactgtcttcctccttttggttaactccctattatgattttctggaccaccaaatatcaaagccacaagtcttaagttaagacttgtcctaaggctgatcccaaagcaacastccttacgagtcgaactttttagatccttaactttggtgacaacccagaagaaattagaatcaattgtccatgcctttgttgagtgcctcatctatgcttggaacttaagtggattttgcagcaataaagaaaaaacacaaatttctatgtaacgaccctgtaatcttgtcagagagataaaatttgaacggacaaaacaacagtgaaatatctaggacaatatnaaatggcattgtactgtctgtacggacctatagaatttgggaagggagaaagggatttgtttaaggctaaggtactccatgaaggttttgtgaaagattttgacttcatttaagccttaaatgataggcaacagttttcctgggagacagggtttgagagatgtggtagcatggggtggtgaaaagaccataggctttagctctgccacttactgcaggctagacccttgtgcaagttgcttatattcactgagctgcagtctcttcatttcaga

SEQ ID NO: 166 - DNA, 1001 bp, Homo Sapiens
  allele 501: 12-752-196 : polymorphic base T or C
  misc_binding 481..500: 12-752-196.mis1, potential
  misc_binding 502..521: 12-752-196.mis2, potential complement
  primer_bind 679..696: upstream amplification primer, complement
  primer_bind 153..173: downstream amplification primer
  misc_binding 489..513: 12-752-196 potential probe
  misc_feature 837: n=a, g, c or t
agatagaaataaagagtatccaaatcagtaaagaggaagtcaaacttttgctattcactgattgattgtttacctagaaaaccctaaagattcatccaaaaagctaccacaaattgaatatgtttgtttctaagtgagtgacatgttacctcgaaaaacagaaactcaaacactcaaatttcatattttgctcagttatgtgaacttaacaatgtttacatgtttaaaaaataagagtagtttggtaattaaatgtaatttgatatttatcaatgtccaatattcctttaactttagtctcataaacatactttcctcaataagtttaggataatgtgtctacccaattcttttaaatgtttgtttatattttttcacaactctttaactacttatagacaagaatcagctctatttagcaaacgtctgaaagttggtgaatcagtaatggaaatagctttggtaagttttgatcagtgaagtacataagctatagtctgyactgtcttcctccttttggttaactccctattatgattttctggaccaccaaatatcaaagccacaagtcttaagttaagacttgtcctaaggctgatcccaaagcaacagtccttacgagtcgaactttttagatccttaactttggtgacaacccagaagaaattagaatcaattgtccatgcctttgttgagtgcctcatctatgcttggaacttaagtggattttgcagcaataaagaaaaaacacaaatttctatgtaacgaccctgtaatcttgtcagagagataaaatttgaacggacaaaacaacagtgaaatatctaggacaatatnaaatggcattgtactgtctgtacggacctatagaatttgggaagggagaaagggatttgtttaaggctaaggtactccatgaaggttttgtgaaagattttgacttcatttaagccttaaatgataggcaacagttttcctgggagacagggtttgagagatgt

SEQ ID NO: 167 - DNA, 1001 bp, Homo Sapiens
  allele 501: 12-752-484 : polymorphic base T or C
  misc_binding 481..500: 12-752-484.mis1, potential
  misc_binding 502..521: 12-752-484.mis2, potential complement
  primer_bind 967..984: upstream amplification primer, complement
  primer_bind 441..461: downstream amplification primer
  misc_binding 489..513: 12-752-484 potential probe
taaacagaactaaaagcaaacatcacatgatcatctcaatagatgcagaaaatgcgtttgacaaaatccagcatccctgtatgattaaaaccctcagcaaaattggtatagaagaaaaaccttttaaggtaataaaagccatatatgacaaactcacagccaacattatactgaatggggaaaagttgaaagaattccccctgagaactggaataagacaaggaggcccacttttaccacttctattcaatatagtacaggaagtcctagccagagcaatcagacaagagatagaaataaagagtatccaaatcagtaaagaggaagtcaaacttttgctattcactgattgattgtttacctagaaaaccctaaagattcatccaaaaagctaccacaaattgaatatgtttgtttctaagtgagtgacatgttacctcgaaaaacagaaactcaaacactcaaatttcatattttgctcagttatgtgaacttaacaaygtttacatgtttaaaaaataagagtagtttggtaattaaatgtaatttgatatttatcaatgtccaatattcctttaactttagtctcataaacatactttcctcaataagtttaggataatgtgtctacccaattcttttaaatgtttgtttatattttttcacaactctttaactacttatagacaagaatcagctctatttagcaaacgtctgaaagttggtgaatcagtaatggaaatagctttggtaagttttgatcagtgaagtacataagctatagtctgtactgtcttcctccttttggttaactccctattatgattttctggaccaccaaatatcaaagccacaagtcttaagttaagacttgtcctaaggctgatcccaaagcaacagtccttacgagtcgaactttttagatccttaactttggtgacaacccagaagaaattagaatcaattgtccatgcctttgttgagtgcctcatctatgcttg

SEQ ID NO: 168 - DNA, 1001 bp, Homo Sapiens
  allele 501: 12-753-139 : polymorphic base C or T
  misc_binding 481..500: 12-753-139.mis1, potential
  misc_binding 502..521: 12-753-139.mis2, potential complement
  primer_bind 364..382: upstream amplification primer
  primer_bind 900..920: downstream amplification primer, complement
  misc_binding 489..513: 12-753-139 potential probe
tagcaaggctgggccttcccggcatcgtcctctacaacacagtcactggcaattcccaaagaccagagtctctttgtgtgtttcctgcaaaattcaacataactcacatactttgtttttgcctgtccattcaagacacaatgtaaccccacagtcccttgtgaacacacatcccatttgcacatgtcaagtatctgattcatttagacttatcccaatcgcttaatgtgcgcaacagaagcctcctggtattctagctctaaacagttgagttaatacccttggacaaagcgggcctgctgtttgggtgagctcccatgggtctgacagccacaaagagaagcttgttgaatgctcacataaaaagagaagagataggaggcagatactctgatctttatgaccctctgattattctatcagttagttaaaacataaatccatcccctgacttaacaaaatactattttacttccttttaccccatattttatcttttayaggcaataaaacataaaaaccttacaaaggttatgttctcatcaatttttgcactaaatgacaataaattaagtgtaggttactgcagcagcaacatagatgtcagcttaaaacttccttgaaagacaacctcccaccattagagttgaaagctgctaatcaaagatttcttgattaaaattaacacccgattttaaaatggcaatgctgctctatttctttaagtagttagggagcctctagccctttctcttgtttcttaaaatctgttttaggagtccacaaataaaaaagaatgtaaaaaagtgaaaaatttatttattgggcacacacaagaaacactttgtggaatcactttgagtttaatgtctttcagcttttattataataaacagcctcccaaaccttcacagcactaaacaggtatcagatgtataaactaaaaatttattttttatttatatgaaagtcattcaaccaatatttgtcaagaggttaca

SEQ ID NO: 169 - DNA, 1001 bp, Homo Sapiens
  allele 501: 12-753-376 : polymorphic base C or T
  misc_binding 481..500: 12-753-376.mis1, potential
  misc_binding 502..521: 12-753-376.mis2, potential complement
  primer_bind 127..145: upstream amplification primer
  primer_bind 663..683: downstream amplification primer, complement
  misc_binding 489..513: 12-753-376 potential probe
gaagcctcctggtattctagctctaaacagttgagttaatacccttggacaaagcgggcctgctgtttgggtgagctcccatgggtctgacagccacaaagagaagcttgttgaatgctcacataaaaagagaagagataggaggcagatactctgatctttatgaccctctgattattctatcagttagttaaaacataaatccatcccctgacttaacaaaatactattttacttccttttaccccatattttatcttttacaggcaataaaacataaaaaccttacaaaggttatgttctcatcaatttttgcactaaatgacaataaattaagtgtaggttactgcagcagcaacatagatgtcagcttaaaacttccttgaaagacaacctcccaccattagagttgaaagctgctaatcaaagatttcttgattaaaattaacacccgattttaaaatggcaatgctgctctatttctttaagtagttagggagyctctagccctttctcttgtttcttaaaatctgttttaggagtccacaaataaaaaagaatgtaaaaaagtgaaaaatttatttattgggcacacacaagaaacactttgtggaatcactttgagtttaatgtctttcagcttttattataataaacagcctcccaaaccttcacagcactaaacaggtatcagatgtataaactaaaaatttattttttatttatatgaaagtcattcaaccaatatttgtcaagaggttacattaaattaaggttaattaaacgagctggtaaacataaagcatctagaacaaaacctggcacatagaaaaagcccagcaagtattagttatcccttgtgcattattattgtcattgctgttattatgatatgtgctattatgtgctatgtattagaaatacaatgacaagctaaacagatatggctctcccactctcctgaatttcaagtgcaagtggcaaagacagacatcaatcaa

SEQ ID NO: 170 - DNA, 1001 bp, Homo Sapiens
  allele 501: 12-754-172 : polymorphic base C or T
  misc_binding 481..500: 12-754-172.mis1, potential
  misc_binding 502..521: 12-754-172.mis2, potential complement
  primer_bind 330..349: upstream amplification primer
  primer_bind 769..788: downstream amplification primer, complement
  misc_binding 489..513: 12-754-172 potential probe
gatagaagaaaaactgtaaatgcgctctagttcagttagggtatcagataagaccgtgagtggctgttgggttcaattctctatttttgcaaaactgggctggaattatttacttttagtaacaatgcattcgccccaccttcaaacatttttctcctccttctttccttttactggaagagagtttcatttgttcacaaaactctttttctcactttaatttcctttaaattcagtccgttttgactcctaaggaaactttcatttttaaaaaaggaccaaactcctttgtttttctcttagatggatgatgccctgccctgctctccagcagcccccacaaagttaggaggttttgtttcttaaattaggccagaactagtcattctgatgaactccaactccaatcaaggacattggccaatctgtcagaacctaaaataaaaataaatccactagcagtgtcttccactttgaatgtttatcctgctgggtgccccyctttctttctgcaatggaagaacccgcttccattttgcaagtctgtgtgtgccccctcgtttggagccatttgcaatctcttgcactcccgtttcaaggtggagccccagccaagatgagtttctctgaagagctgctaccctaattcctccccttcacttcgaagcttgtcagggggacccaagcaataagaaggtcaataggaaaacaaatcccaccgtattaagtcttgtttgatcttaaaaccacatcatccgagatttcagcgacattatgctggctccgcacaagaggaacagagttttcttatgaaaataaattagacaagcacacagaagaaaaagaaaatgatgtgcaacggttaaaatgtttgagagccttacatgtggccagcgagctcagcaaaggacactggtttctttttctctcttctttagtcttttattccctactctctgttctccttgcagcaaaacaaatatttttcctaccacaaatat

SEQ ID NO: 171 - DNA, 1001 bp, Homo Sapiens
  allele 501: 12-754-218 : polymorphic base C or T
  misc_binding 481..500: 12-754-218.mis1, potential
  misc_binding 502..521: 12-754-218.mis2, potential complement
  primer_bind 284..303: upstream amplification primer
  primer_bind 723..742: downstream amplification primer, complement
  misc_binding 489..513: 12-754-218 potential probe
gataagaccgtgagtggctgttgggttcaattctctatttttgcaaaactgggctggaattatttacttttagtaacaatgcattcgccccaccttcaaacatttttctcctccttctttccttttactggaagagagtttcatttgttcacaaaactctttttctcactttaatttcctttaaattcagtccgttttgactcctaaggaaactttcatttttaaaaaaggaccaaactcctttgtttttctcttagatggatgatgccctgccctgctctccagcagcccccacaaagttaggaggttttgtttcttaaattaggccagaactagtcattctgatgaactccaactccaatcaaggacattggccaatctgtcagaacctaaaataaaaataaatccactagcagtgtcttccactttgaatgtttatcctgctgggtgcccccctttctttctgcaatggaagaacccgcttccattttgcaagtctgygtgtgccccctcgtttggagccatttgcaatctcttgcactcccgtttcaaggtggagccccagccaagatgagtttctctgaagagctgctaccctaattcctccccttcacttcgaagcttgtcagggggacccaagcaataagaaggtcaataggaaaacaaatcccaccgtattaagtcttgtttgatcttaaaaccacatcatccgagatttcagcgacattatgctggctccgcacaagaggaacagagttttcttatgaaaataaattagacaagcacacagaagaaaaagaaaatgatgtgcaacggttaaaatgtttgagagccttacatgtggccagcgagctcagcaaaggacactggtttctttttctctcttctttagtcttttattccctactctctgttctccttgcagcaaaacaaatatttttcctaccacaaatatttttaaggtgctacttttcaattaacgatgttttatttcttttgtg

SEQ ID NO: 172 - DNA, 1001 bp, Homo Sapiens
  allele 501: 12-754-328 : polymorphic base G or C
  misc_binding 481..500: 12-754-328.mis1, potential
  misc_binding 502..521: 12-754-328.mis2, potential complement
  primer_bind 176..195: upstream amplification primer
  primer_bind 615..634: downstream amplification primer, complement
  misc_binding 489..513: 12-754-328 potential probe
tcctccttctttccttttactggaagagagtttcatttgttcacaaaactctttttctcactttaatttcctttaaattcagtccgttttgactcctaaggaaactttcatttttaaaaaaggaccaaactcctttgtttttctcttagatggatgatgccctgccctgctctccagcagcccccacaaagttaggaggttttgtttcttaaattaggccagaactagtcattctgatgaactccaactccaatcaaggacattggccaatctgtcagaacctaaaataaaaataaatccactagcagtgtcttccactttgaatgtttatcctgctgggtgcccccctttctttctgcaatggaagaacccgcttccattttgcaagtctgtgtgtgccccctcgtttggagccatttgcaatctcttgcactcccgtttcaaggtggagccccagccaagatgagtttctctgaagagctgctaccctaattcctcccsttcacttcgaagcttgtcagggggacccaagcaataagaaggtcaataggaaaacaaatcccaccgtattaagtcttgtttgatcttaaaaccacatcatccgagatttcagcgacattatgctggctccgcacaagaggaacagagttttcttatgaaaataaattagacaagcacacagaagaaaaagaaaatgatgtgcaacggttaaaatgtttgagagccttacatgtggccagcgagctcagcaaaggacactggtttctttttctctcttctttagtcttttattccctactctctgttctccttgcagcaaaacaaatatttttcctaccacaaatatttttaaggtgctacttttcaattaacgatgttttatttcttttgtgtgatggggtttttctttttcgcactgaaatgataaagacactgaagatggcaaagggaagccctaggaacagccttgctacaatccatcagctgcgataatatcaaga

SEQ ID NO: 173 - DNA, 1001 bp, Homo Sapiens
  allele 501: 12-754-396 : polymorphic base G or T
  misc_binding 481..500: 12-754-396.mis1, potential
  misc_binding 502..521: 12-754-396.mis2, potential complement
  primer_bind 110..129: upstream amplification primer
  primer_bind 549..568: downstream amplification primer, complement
  misc_binding 489..513: 12-754-396 potential probe
tttcctttaaattcagtccgttttgactcctaaggaaactttcatttttaaaaaaggaccaaactcctttgtttttctcttagatggatgatgccctgccctgctctccagcagcccccacaaagttaggaggttttgtttcttaaattaggccagaactagtcattctgatgaactccaactccaatcaaggacattggccaatctgtcagaacctaaaataaaaataaatccactagcagtgtcttccactttgaatgtttatcctgctgggtgcccccctttctttctgcaatggaagaacccgcttccattttgcaagtctgtgtgtgccccctcgtttggagccatttgcaatctcttgcactcccgtttcaaggtggagccccagccaagatgagtttctctgaagagctgctaccctaattcctccccttcacttcgaagcttgtcagggggacccaagcaataagaaggtcaataggaaaacaaatcccaccktattaagtcttgtttgatcttaaaaccacatcatccgagatttcagcgacattatgctggctccgcacaagaggaacagagttttcttatgaaaataaattagacaagcacacagaagaaaaagaaaatgatgtgcaacggttaaaatgtttgagagccttacatgtggccagcgagctcagcaaaggacactggtttctttttctctcttctttagtcttttattccctactctctgttctccttgcagcaaaacaaatatttttcctaccacaaatatttttaaggtgctacttttcaattaacgatgttttatttcttttgtgtgatggggtttttctttttcgcactgaaatgataaagacactgaagatggcaaagggaagccctaggaacagccttgctacaatccatcagctgcgataatatcaagatgaatatattgtcaggaatctgtatgtagcatttcatttatcctacccactctcctaagagcggct

SEQ ID NO: 174 - DNA, 1001 bp, Homo Sapiens
  allele 501: 12-755-280 : polymorphic base G or C
  misc_binding 481..500: 12-755-280.mis1, potential
  misc_binding 502..521: 12-755-280.mis2, potential complement
  primer_bind 222..242: upstream amplification primer
  primer_bind 688..708: downstream amplification primer, complement
  misc_binding 489..513: 12-755-280 potential probe
acaaatcccaccgtattaagtcttgtttgatcttaaaaccacatcatccgagatttcagcgacattatgctggctccgcacaagaggaacagagttttcttatgaaaataaattagacaagcacacagaagaaaaagaaaatgatgtgcaacggttaaaatgtttgagagccttacatgtggccagcgagctcagcaaaggacactggtttctttttctctcttctttagtcttttattccctactctctgttctccttgcagcaaaacaaatatttttcctaccacaaatatttttaaggtgctacttttcaattaacgatgttttatttcttttgtgtgatggggtttttctttttcgcactgaaatgataaagacactgaagatggcaaagggaagccctaggaacagccttgctacaatccatcagctgcgataatatcaagatgaatatattgtcaggaatctgtatgtagcatttcatttatcctacccactctsctaagagcggctcccccggggattacattattattcaagcttcctggactcactccaaatgcatattgcaactacaattcaaagggaaacttataaaaggtgataggaaatagaccttctacagaacattttttaaaaattaaccttttcagagtttaattccatcctatatacctataaatagaccagctttcaggaactaaaaactaatcctatagtaataacacaaagctcaatttctcattccatacgatcattaatattactttaaaaatcacgagaaatctcttcaacttcttaagcattgtaattcatttctgtacaccaattcaagaaacctcattagtttaggtggcctttttgcaataccatccaaggcacgcaaatatttggaatttttaccttaggtcagagtttaagaaaaaaatgatttctcatttccagaaaggatttatgaatgtagaaaaatgcttttatgacagtgacatgtttgtgttacc

SEQ ID NO: 175 - DNA, 1001 bp, Homo Sapiens
  allele 501: 12-757-384 : polymorphic base C or T
  misc_binding 481..500: 12-757-384.mis1, potential
  misc_binding 502..521: 12-757-384.mis2, potential complement
  primer_bind 118..135: upstream amplification primer
  primer_bind 628..647: downstream amplification primer, complement
  misc_binding 489..513: 12-757-384 potential probe
  misc_feature 664: n=a, g, c or t
ttctccagaaacaccttaaaatgcattcactcaagcaaacaggaattcatgagagctcttaaatatacaagaactcttaaaatacacaaaaattatgcacaaatgcaaggcaatgctccttactgatctgggaacagagaaagtctacctcatgaggtggcatctctccccaggtgtccttcaactggccatgggagggacagttttttcccatcagcaccactgtcagaggccaatagcatgagatgtagtggctgcaggctgggtggatcatgtcacccatcactgcccctgtgacgttgagtgcacccatctgcaaggagaaggtatatccccagtggagcaaggctcccagaggcctcagttcttagatggaagtgagtatggcttttctctgatacctgttccaatagggaattcaaagtgagggggaaatattaaagggagttattatattcaagtatttccataatttgttaactgtaaaatatatatcatttytatggcttcaaaataatctacttagaagcctcactaaagataaggatctttgtgaaaattcctgcctttgaccagaaatctgggttaaaacagattgagaaatgagagcttctctttgatacctcacatttttaggtcttgaagggactctgcacattatagnatttcaaacttctcattttacagattagaaagaaaacaaagaggctgggcacagtggcttatgcctgtaatcccagcactttgggaggtcaaggtgagcagatcacttgaggccaggagttcaagaccagcccggccaacatggtgaaatcccgactctactaaaaatacaaaaattagctgggtttggtggcaggtgcctgcaatcccagctactcaggaggctgaggcaggagagttgcttagacccaggaggtggaggttgcagtgagccaagatcacaccactgcactccagcctggctgacagagtgagagaaagaaggaaagaaggaaagg

SEQ ID NO: 176 - DNA, 1001 bp, Homo Sapiens
  allele 501: 12-758-257 : polymorphic base A or C
  misc_binding 481..500: 12-758-257.mis1, potential
  misc_binding 502..521: 12-758-257.mis2, potential complement
  primer_bind 245..264: upstream amplification primer
  primer_bind 749..768: downstream amplification primer, complement
  misc_binding 489..513: 12-758-257 potential probe
taatactaagaaactaataaatgaaataaatgtgaatcacttgagagaagaaatcacaaagcattagaacacttattggattctcaattagtgtaacctgttatcttgaaggagcatttctttcatataggcccatagcctggtcggccctgactggtccagcattgactacctcctcagccaagtcctgcttcaggcccctcccaagacgagctgccctcagccatttcagccacccgagggaacagatagctgcggtggttctctcccctgcctctctcactgagctcttcctctccctttccgtcagtattcagaagcataacttatatacttctaaactcttttcgactgagtaaaattaagcctctgaaataaaatctttactttatcttcgttttctctcaaaatcagcctcaactctagatgccttcatctgagaggatgttttttctcatctccatttcaaattgttgtctttcactgtacatgtctctcagmcttcaatccctccgtgtctctcaaatctgtgagtgtggaatgagtgtgtgtatcttcttaataaaaatgtctcttttgacatgagctgtacttgtcataaaaacttctctcagtaactgcctaatttactcaactctttcctcctaaaaatctccatactttgggaagaaatagtcactgcatgccgtatgtctctcatagttctaaccataacctctagacacctctgtctgaacacctctcccctctcagtagcagtcagaatggcccagacctctgttaaagaaaacacatagcttttctgggtatcataaacaaacaactaagactgcaaaaaacaaatctgccaacttaagcaagtgcaataaaatgttcacatagctgggtttggatcagaagcattcaatgagtgttatcttcagcgtccttattattctaacaccaggtgctaatcatcagtagatcagtctacaaatcattaaatctcatcaaggaaactt

SEQ ID NO: 177 - DNA, 1001 bp, Homo Sapiens
  allele 501: 12-758-374 : polymorphic base A or C
  misc_binding 481..500: 12-758-374.mis1, potential
  misc_binding 502..521: 12-758-374.mis2, potential complement
  primer_bind 128..147: upstream amplification primer
  primer_bind 632..651: downstream amplification primer, complement
  misc_binding 489..513: 12-758-374 potential probe
ttctttcatataggcccatagcctggtcggccctgactggtccagcattgactacctcctcagccaagtcctgcttcaggcccctcccaagacgagctgccctcagccatttcagccacccgagggaacagatagctgcggtggttctctcccctgcctctctcactgagctcttcctctccctttccgtcagtattcagaagcataacttatatacttctaaactcttttcgactgagtaaaattaagcctctgaaataaaatctttactttatcttcgttttctctcaaaatcagcctcaactctagatgccttcatctgagaggatgttttttctcatctccatttcaaattgttgtctttcactgtacatgtctctcagacttcaatccctccgtgtctctcaaatctgtgagtgtggaatgagtgtgtgtatcttcttaataaaaatgtctcttttgacatgagctgtacttgtcataaaaacttctctcagtaamtgcctaatttactcaactctttcctcctaaaaatctccatactttgggaagaaatagtcactgcatgccgtatgtctctcatagttctaaccataacctctagacacctctgtctgaacacctctcccctctcagtagcagtcagaatggcccagacctctgttaaagaaaacacatagcttttctgggtatcataaacaaacaactaagactgcaaaaaacaaatctgccaacttaagcaagtgcaataaaatgttcacatagctgggtttggatcagaagcattcaatgagtgttatcttcagcgtccttattattctaacaccaggtgctaatcatcagtagatcagtctacaaatcattaaatctcatcaaggaaacttctacacttactttccttggcagaagtgaatccattctttaatatatgtgtggagacaaattaattcttctccttctagataattcctacctgggagagctctatcataacatacatc

SEQ ID NO: 178 - DNA, 1001 bp, Homo Sapiens
  allele 501: 12-758-424 : polymorphic base A or G
  misc_binding 481..500: 12-758-424.mis1, potential
  misc_binding 502..521: 12-758-424.mis2, potential complement
  primer_bind 79..98: upstream amplification primer
  primer_bind 583..602: downstream amplification primer, complement
  misc_binding 489..513: 12-758-424 potential probe
gactacctcctcagccaagtcctgcttcaggcccctcccaagacgagctgccctcagccatttcagccacccgagggaacagatagctgcggtggttctctcccctgcctctctcactgagctcttcctctccctttccgtcagtattcagaagcataacttatatacttctaaactcttttcgactgagtaaaattaagcctctgaaataaaatctttactttatcttcgttttctctcaaaatcagcctcaactctagatgccttcatctgagaggatgttttttctcatctccatttcaaattgttgtctttcactgtacatgtctctcagacttcaatccctccgtgtctctcaaatctgtgagtgtggaatgagtgtgtgtatcttcttaataaaaatgtctcttttgacatgagctgtacttgtcataaaaacttctctcagtaactgcctaatttactcaactctttcctcctaaaaatctccatactttgggragaaatagtcactgcatgccgtatgtctctcatagttctaaccataacctctagacacctctgtctgaacacctctcccctctcagtagcagtcagaatggcccagacctctgttaaagaaaacacatagcttttctgggtatcataaacaaacaactaagactgcaaaaaacaaatctgccaacttaagcaagtgcaataaaatgttcacatagctgggtttggatcagaagcattcaatgagtgttatcttcagcgtccttattattctaacaccaggtgctaatcatcagtagatcagtctacaaatcattaaatctcatcaaggaaacttctacacttactttccttggcagaagtgaatccattctttaatatatgtgtggagacaaattaattcttctccttctagataattcctacctgggagagctctatcataacatacatcatacagatggtctaaaagtgatgtcttctatttagcagttattaagagc

SEQ ID NO: 179 - DNA, 701 bp, Homo Sapiens
  allele 541: 12-761-23 : polymorphic base G or A
  misc_binding 521..540: 12-761-23.mis1, potential
  misc_binding 542..561: 12-761-23.mis2, potential complement
  primer_bind 545..563: upstream amplification primer, complement
  primer_bind 1..21: downstream amplification primer
  misc_binding 529..553: 12-761-23 potential probe
atggagttgggtgtatttggggacccatacaaaggtattatttatttctaggatccagaagaccttcttggaggtcactgaaactctgagcatcacttttctcccttcaaatgtttattgaacacctactttgtgtcaggcactgagataggagttctacgtagaccgtctgtaatctatgactgacttgttcatctttttgttctcaggacctagtacaggacctggcacatagtaggtggctcaataatagaagtcattatcatcatcatcatcatcatcatcacttttgttactggtatataggttcattggtgacatagagatgaacattttcagaggtgtgttcctgtaagattggtggaacccataagtcctggtcctggaagctgtcagccaccaaagtgatggtttgcaggggagtgggacagaatgactgcttcaacagggcttcctctcacacaattcaccacgcacatgataagttcccatgaggctagaaggggttaacccattagtggttagaaaaatcatttttgtrttcctcatcagaaatctacagggtgaacttttcaaagaggcttgcatattccacacgaattgcttctaagtcaaactacaaaaagagacttaatgagattgttttaaccatgacatctttgagcgcctctgtgcaaggcaatactttaggcgactcatat

SEQ ID NO: 180 - DNA, 1001 bp, Homo Sapiens
  allele 501: 12-761-178 : polymorphic base G or A
  misc_binding 481..500: 12-761-178.mis1, potential
  misc_binding 502..521: 12-761-178.mis2, potential complement
  primer_bind 660..678: upstream amplification primer, complement
  primer_bind 116..136: downstream amplification primer
  misc_binding 489..513: 12-761-178 potential probe
ggactaatgagggacgaacccaaagtcaagcttgtgtaagactgtttgaactggataggccccaaatgcaatagaatctcagagctatgtcactcatcaaggagctggatcaggtatggagttgggtgtatttggggacccatacaaaggtattatttatttctaggatccagaagaccttcttggaggtcactgaaactctgagcatcacttttctcccttcaaatgtttattgaacacctactttgtgtcaggcactgagataggagttctacgtagaccgtctgtaatctatgactgacttgttcatctttttgttctcaggacctagtacaggacctggcacatagtaggtggctcaataatagaagtcattatcatcatcatcatcatcatcatcacttttgttactggtatataggttcattggtgacatagagatgaacattttcagaggtgtgttcctgtaagattggtggaacccataagtcctggtcctgraagctgtcagccaccaaagtgatggtttgcaggggagtgggacagaatgactgcttcaacagggcttcctctcacacaattcaccacgcacatgataagttcccatgaggctagaaggggttaacccattagtggttagaaaaatcatttttgtattcctcatcagaaatctacagggtgaacttttcaaagaggcttgcatattccacacgaattgcttctaagtcaaactacaaaaagagacttaatgagattgttttaaccatgacatctttgagcgcctctgtgcaaggcaatactttaggcgactcatattcatcaacacgcttaaagctcatctagtcctctcgtggcattattgacttcatgtcccattttagacatgaagaaactaagtctcagacaaccaggaggacagggagcctagggtgacacctgccaagccttacaagaagtcctccttcaagaaaagcagagagctaggaaaagtctagagaagg

SEQ ID NO: 181 - DNA, 1001 bp, Homo Sapiens
  allele 501: 12-764-329 : polymorphic base G or A
  misc_binding 481..500: 12-764-329.mis1, potential
  misc_binding 502..521: 12-764-329.mis2, potential complement
  primer_bind 811..828: upstream amplification primer, complement
  primer_bind 355..373: downstream amplification primer
  misc_binding 489..513: 12-764-329 potential probe
atgcctctgaccttcttttagtaaagatgatttcttctcagctttgatactggtatgctcagtaatcttagtcaagtcaagtcgtggtcttccccataatctaggtaaggagaggatctggacagttttcctttgttttccaagtcaacccccactctcccgagaccttcatcaaacacaaatgaaatccattttctttgtgcagtcagtgtgtctcggcagatgtgagtcagcatcctgttcagaacggctgttggtgccttgccatggacaataaagacacacattttccatggaatgccaggcgcttgagctgacttggggtttccacccgcagagaggaggaggaaactccaggaggctgattttgtggttttggatccagccatcattttaaactgcaaatattctctgtgcttgaaaaatatggtgaatgatttatgggacccatgacccccaggtttctactggcaccttgctgtcagcaacacctccccgtgrcattcccttggcaaagctattgcttcggactgactggcatttggaacagtgactgacctctgggggtgcccacgatccaggtgttgaaaatattgttgtagttagctaattagattagttggctattttcgttcaacgagtaaatgcttaaagatttccttgtgctgtttcttatcaggagccaaatacatttgtgtcttggttcctcaccaatgttggaaaactgtaacttctgttagttttgaaaaaaaattgtaaaaaatctgcctggatcacagaattcatgttctcacccatattctgtggggtcaccctatccacatcactcttctttggggagagcctttgcttagatgactttgtgatcactcatatcagacacacgaggaagaggatggaaaagaaagtgatattcaggttttctgtttcttctttatgccctcgccccacccacacagtttctttagaccctgtgcccttccgcccagcaaacacttcct

SEQ ID NO: 182 - DNA, 1001 bp, Homo Sapiens
  allele 501: 12-764-377 : polymorphic base G or A
  misc_binding 481..500: 12-764-377.mis1, potential
  misc_binding 502..521: 12-764-377.mis2, potential complement
  primer_bind 859..876: upstream amplification primer, complement
  primer_bind 403..421: downstream amplification primer
  misc_binding 489..513: 12-764-377 potential probe
ccacatgtacacacccataactctgtggcattgtcctctctttgtggcatgcctctgaccttcttttagtaaagatgatttcttctcagctttgatactggtatgctcagtaatcttagtcaagtcaagtcgtggtcttccccataatctaggtaaggagaggatctggacagttttcctttgttttccaagtcaacccccactctcccgagaccttcatcaaacacaaatgaaatccattttctttgtgcagtcagtgtgtctcggcagatgtgagtcagcatcctgttcagaacggctgttggtgccttgccatggacaataaagacacacattttccatggaatgccaggcgcttgagctgacttggggtttccacccgcagagaggaggaggaaactccaggaggctgattttgtggttttggatccagccatcattttaaactgcaaatattctctgtgcttgaaaaatatggtgaatgatttatgggacccatgrcccccaggtttctactggcaccttgctgtcagcaacacctccccgtggcattcccttggcaaagctattgcttcggactgactggcatttggaacagtgactgacctctgggggtgcccacgatccaggtgttgaaaatattgttgtagttagctaattagattagttggctattttcgttcaacgagtaaatgcttaaagatttccttgtgctgtttcttatcaggagccaaatacatttgtgtcttggttcctcaccaatgttggaaaactgtaacttctgttagttttgaaaaaaaattgtaaaaaatctgcctggatcacagaattcatgttctcacccatattctgtggggtcaccctatccacatcactcttctttggggagagcctttgcttagatgactttgtgatcactcatatcagacacacgaggaagaggatggaaaagaaagtgatattcaggttttctgtttcttctttatgccctcgccccaccc

SEQ ID NO: 183 - DNA, 1001 bp, Homo Sapiens
  allele 501: 12-765-168 : polymorphic base G or A
  misc_binding 481..500: 12-765-168.mis1, potential
  misc_binding 502..521: 12-765-168.mis2, potential complement
  primer_bind 649..668: upstream amplification primer, complement
  primer_bind 74..94: downstream amplification primer
  misc_binding 489..513: 12-765-168 potential probe
atcgtaggtaaaagaaaaaactgaagaaaggtctttgatcagctgccctaaggttttcagctaatatatgacatagaaatgtgtaagggttctgggagattgatggaccgccaagatctgagatggctatggttgccgcagacatccccacaagatggcgctcttctttattttccattcatcttaattttaaaaagtgatttttacagtttcagaataaaacagaatcatgaaatatgtagatggtttcatatattatcctgtttaatgttgcaacatacatcgcagttataaaaatcagcgtccccctcccccaccctgtcaggaggcgatccctgcctggatccccaagggtagggtgaggggtgttgatggtgctcttaggaaatgccaggacttggcagaaagggagtgtgtggggtgtggatgtgtgttgcaagattctgtttttcctaaaaggtgaatttagtcttaaaagtatgttaataagattttctcatrtattaagagttttctatcatcaaggctaaagcagaggcttcccaatcacagccccttcctccacaaattcccctcctgaagggactgtgctgtctatatcccctccctcccacagcagttcctctcctgggctattgaaatagcaatggattcataactctctttagaaagcagcagacagcaactgatttcgcaggaaaatgagtaaaaagaaaataatatgttgaagttatcttaaaacctcatggatttgggctagagttcccaatgattgcctccaccatactctggttccaaaaactagactgaaatattttgctaataaagaaattgatcctggcttttcaacaaatgaggctggaacaactggatgtccatatgcaaaaagaatagcctagagaaagaccttataccttacataaaaattaattcagaatgggccaggtgcagaggctcatgcctgtaataccagcactttgggaggccaaggcaggcggata

SEQ ID NO: 184 - DNA, 1002 bp, Homo Sapiens
  allele 501: 12-765-504 : polymorphic base T or C
  misc_binding 481..500: 12-765-504.mis1, potential
  misc_binding 502..521: 12-765-504.mis2, potential complement
  primer_bind 983..1002: upstream amplification primer, complement
  primer_bind 408..428: downstream amplification primer
  misc_binding 489..513: 12-765-504 potential probe
  misc_feature 127: n=a, g, c or t
aaataaatgatcaccgtattctttaagataagactagccgcatttgaaaatcacataatataaagcatcctctctgaaaatttctggaattctcattccttgtttatgtacctggatttaactcccnctactctatgctcaaatcacttgattgactgagatgctgtcactcttgtcactcaagagtcttatacaaaatagagtatggaaagaaactaataatgtgcatttttattataaatgccaattttagcacatctcaatgactgattttatagatcattaggaagtagcttttagtcatttatgaaaataaaagcccatagaattattcatcgtaggtaaaagaaaaaactgaagaaaggtctttgatcagctgccctaaggttttcagctaatatatgacatagaaatgtgtaagggttctgggagattgatggaccgccaagatctgagatggctatggttgccgcagacatccccacaagatggcgctcttcyttattttccattcatcttaattttaaaaagtgatttttacagtttcagaataaaacagaatcatgaaatatgtagatggtttcatatattatcctgtttaatgttgcaacatacatcgcagttataaaaatcagcgtccccctcccccaccctgtcaggaggcgatccctgcctggatccccaagggtagggtgaggggtgttgatggtgctcttaggaaatgccaggacttggcagaaagggagtgtgtggggtgtggatgtgtgttgcaagattctgtttttcctaaaaggtgaatttagtcttaaaagtatgttaataagattttctcatatattaagagttttctatcatcaaggctaaagcagaggcttcccaatcacagccccttcctccacaaattcccctcctgaagggactgtgctgtctatatcccctccctcccacagcagttcctctcctgggctattgaaatagcaatggattcataactctctttag

SEQ ID NO: 185 - DNA, 1001 bp, Homo Sapiens
  allele 501: 10-372-279 : polymorphic base C or T
  misc_binding 481..500: 10-372-279.mis1, potential
  misc_binding 502..521: 10-372-279.mis2, potential complement
  primer_bind 224..242: upstream amplification primer
  primer_bind 627..646: downstream amplification primer, complement
  misc_binding 489..513: 10-372-279 potential probe
gtaattatgtaactatgcctgcatcttagtaaaattcaggcccctctcatcctcctaacttggtagacttccattaattttacaagggtagtttagcttttgggaagagctagtatcatttaaactataaactaaattcctcctgaagttagtttgccccacacccaggaatgagcaaagacagccagcctgtgaggctagaagcaagatggagtcaaccatgtcagatttctcttactgtcataattttccaaaggcaatttcagagccactcctgaagtggtaggaaggtgtgcgaattatgggtttgtcatatgcctctcatatgcatgaaggaatatgcatatgtaatacaagaaagatgtcattttgaaccaatgggactttcaagtatttccttctaggttggacaccgaggaacagtaagagattatccagactttagcccatcagtggatgctgaagctattcagaaagcaatcagaggaattggtgagtgayattttacaattcctttcttaatgttgaagcaaatcaggcaagttacaatctaaaagttcagtttgctcagattggcttactcaatttaataaattgtcaggaattttctaaaattgtgaaataacgaggaaatatatagagaacccagttttattaaatcttaacatttatcatatttacttaatattaaaaattaccactgatactagtggtctaggggagatccccaaatgccgggggaatctcaaccctggctggtatccagactcttgacaccatctagagaagaaattcaaggatgggtcaaaaaatactgaaaacacagagatttattgcaaagtgaaaaatacacactcaggaaaggggagtgtgagtgtactcaagagacagtcgtgcacaagggggtttggggctgttgcctttatgggtttctttaaccaaggggtggaatagtcatgaagattctgggaaaaaggtgatttcttgaaactgtagtgcca

SEQ ID NO: 186 - DNA, 1001 bp, Homo Sapiens
  allele 501: 10-375-136 : polymorphic base C or T
  misc_binding 481..500: 10-375-136.mis1, potential
  misc_binding 502..521: 10-375-136.mis2, potential complement
  primer_bind 366..385: upstream amplification primer
  primer_bind 765..784: downstream amplification primer, complement
  misc_binding 489..513: 10-375-136 potential probe
tgatataaacaggactgagaggtaattagtccccatgccagccaggcccatgatgcacattactgaggatttgaaaggctccctgtatgaagagaatgatacatgctgatagacccagtacagtgatgcaaggatgaaatcattcaaaagtattatagagccttttctaaacatagtggaatgtttgaatgttggtagggttaatcctgttagactgtcacttctaatcttgaatgacacaggctttttcttttatactatttctttccagaattattcaattgattttcacactagagtgaaaaatttgctgtcactttattccagatgatttatgttattactaaaatatatggaaaaatagaaaacgagagcaatagagaaccttgtattgatttacttaaaagtgtcctttcatctatataaacaagataataagaccaaaaggcatgagattaagttatttaagtgttctaaaaattagattttcttttccttttyagggcgcgggaacaaacgaagatgccttgattgaaatcttaactaccaggacaagcaggcaaatgaaggatatctctcaagcctattatacaggtgtcttattttctgcttaccttcaccactgttcacacatatttgagccaatgttgcttttcctagaatcctctcaatctcttcatgaggcattttgagaagacaagacttacagaaacgagaatacattctaaaatcagctaaagactatgagtttccaggaaaaattggaatatgatctgagctagagactgctacataacaatagcattaatgctttacatttataatattacagctgcagtggattttgctctcggcaatctctcattaattgaattaaccattgtcatcaatgtaagagactcaaatcgtattttatttttaggcgttagaaatcactcagattagatccacgattttgggtgtgggaaattagattaatttagaggatgtgttgagcataa

SEQ ID NO: 187 - DNA, 1001 bp, Homo Sapiens
  allele 501: 10-376-281 : polymorphic base A or T
  misc_binding 481..500: 10-376-281.mis1, potential
  misc_binding 502..521: 10-376-281.mis2, potential complement
  primer_bind 221..239: upstream amplification primer
  primer_bind 646..665: downstream amplification primer, complement
  misc_binding 489..513: 10-376-281 potential probe
  misc_feature 397: n=a, g, c or t
gtttttaagctgtgtacattatatcttgcttaaggttagggttctcttagtatggaagatggccagaatggaaattgaaaggcacactagtagctcatccaccccagcttttccactatgcatcccttagtgccattgtcagatgaaataaaccaagatttgctccagaatgacaactctttctattcttttgcatctaccacaacacagtgcagtaagagttacaagaagaatgtaccatctcacaacagaaaagcatgaagaaattaaataaaagggcaagatttatcttatcacatacccattctttgctagtgttggcatttaaacttttctctgttttataatcatatttttcagtttgtcaaggcttaatttcattctgatttggtttcangtatacaagaagagtcttggagatgacattagttccgaaacatctggtgacttccggaaagctctgttgactttggcagatgtaaggttttattttttattttwtaactccccagtaagctgcatgctcaataacaatttttagggagtttaaaaataaccaaactgagacaatgagttcacaattttccttatgaaatggtttgttcattttacattttcattgccaccaagcaatataatgtttaaccaagatcataaaagcatacataatgatgtaacaacaaagaaaacttatttgagtcagtaagtggaggtgttttggtcaggtttcacaattttgacattagaagacattctgatacatcatctgacatacaatatttatttccattataagtgtctccattttaaagaacaggtttattttcttctggactctgaagaataaatatttcttttgttagcttctaaattaaataggaagcatgatacagaagaatgatctttagagatgggaattaaattgagtatcagtctcaggattaaaaaaaagaaaatgattgctgcaatttcagccttgccaccttggaaaagctgccaaa

SEQ ID NO: 188 - DNA, 1001 bp, Homo Sapiens
  allele 501: 10-369-392 : polymorphic base C or T
  misc_binding 481..500: 10-369-392.mis1, potential
  misc_binding 502..521: 10-369-392.mis2, potential complement
  primer_bind 111..129: upstream amplification primer
  primer_bind 512..531: downstream amplification primer, complement
  misc_binding 489..513: 10-369-392 potential probe
  misc_feature 141: n=a, g, c or t
atctctgctttgcagcatttagcatgatgctgtcacagagtaggtgctcaacaaatatttcttgaataatgaatgatgagtttgataataaatgaaaaagaatcactatagttgaatattttgcacaccattatctgattncttataaatatagatctctatgttgctttgtgaccaatgacatttgtgttgtgaacacctgcattccttaacagggtattggaactgatgagtttactctgaaccgaataatggtgtccagatcagaaattgaccttttggacattcgaacagagttcaagaagcattatggctattccctatattcagcaattaaagtaagtctacttttaaaaatagcaaaacatattttgcccttctctacccatctccttactcttatatgccttaaaatataaagatatttgacttagatttctctctccttgtcaatgtataaatgtgttgtctgagcttaaaatagtagcagcaaaatatccyttattttcagctctaaaatcccaggcatataatagacactcaatatttttttaggtgtactagccactaatttttcttcttttgtgaattacatatgcaagttgtttacctgttttttatattgcactgtttttatttatttcagtctttatgacaatgtaagaaaagaaaaatacgtattttaaatttcctctctgttttacatgagacagcatggttctgcagcttagagtgcttttcatttcagtatataggaaactttctcattttatttaacagctgtatatcattccattgtttgtatatttgtacccaccacaacaaacagaggcttccagtttattgctattgcaaacaatgttgtataatgcatacacaacttcatcaggtacgagtgtatctttgggatgaattctcagaagtaggatttctgagacagatataaatgcattttaaattttgacaaatattactaattgaattccattttgcaattccat

SEQ ID NO: 189 - DNA, 1001 bp, Homo Sapiens
  allele 501: 10-371-257 : polymorphic base A or C
  misc_binding 481..500: 10-371-257.mis1, potential
  misc_binding 502..521: 10-371-257.mis2, potential complement
  primer_bind 246..263: upstream amplification primer
  primer_bind 661..679: downstream amplification primer, complement
  misc_binding 489..513: 10-371-257 potential probe
tatgaatgaatgatggaattgcaggtatgttttactaaatggtatagctcatgagtctcacacccaggtgaattccctagtgctataggatttgattcatttatggtctcccattatttatactgtatttgtttttcattgattttattctttgcagtcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctamtccattaaatataaagcaagataataaaaattgttgcttttgttaaaagtaatttctttgtttgctttcagagcttgccaacattgtttgatgcctggtgccaacaactaatattttaaaacatgtttctgtatagaagctgttactgcttcagtttatcaccttgttaatcacacttttttgaaagaaaggaataagatgaagatgtatgtgaccctggcctaccctttgtagttgtgatcaagctataggagtggtaatgcatgataagttatttcagctttcagaaaacatctgctgaaggattaatctaaccacttcctgtctgaatggcaagcatgaattatggttgcttcatgctaaatactactttcccagaatgggcatttagaatcaagcctctaaggtttccttttctcttgagttggcaaaactatgcatttaaagaatccatcatgccatctttgagtgggacctaatatgaaataccttgactgata

SEQ ID NO: 190 - DNA, 1001 bp, Homo Sapiens
  allele 501: 12-513-389 : polymorphic base C or T
  misc_binding 481..500: 12-513-389.mis1, potential
  misc_binding 502..521: 12-513-389.mis2, potential complement
  primer_bind 114..133: upstream amplification primer
  primer_bind 610..627: downstream amplification primer, complement
  misc_binding 489..513: 12-513-389 potential probe
ggataacccacagttttactttgtctttaaaacattaattttggggtcatatcaaactgggttcaaatcctggcttcaccacttatggcagcagcgtagataacagtgcttgacaaatacttaacctccatacaactcaattctttagctgacaataacagcacctaccttaaatatgtgcaaggatgaaatgaaataaagcatgtgaaaaatttaactcaataaaaattagttaccaataactgcattggcatggtgagttgccagtgaagagcagatagtaagtgttcaacaagcatttgtagaataaataagcgatacttgttttagtactactcagcgacagtaactctgaggccttggaagcttcagagaactgtcagctgaaatcagtgttattaatatgttgtcagtgtgtcctccaacgataagagccaactgtgttcacctcagtgatgaggttacaggatctgaagaaagtttcctagtcttatttcctgyccatcagttgacagtagtatgacatgtgagggagtgagtcgcttactctttctgtaccttagtttcctcacctgtaaagccaggatggccatgcaagtatcattgagagtaggcgtgaggtttcaataagccagattaggtgatgcacttaccacagtgcctgcacccgttaagtgctcaataaacattagccattattctctggctcagtttggaagacttacaattgcttatacagtgctctaatcacttgggggattttgagatgttgtaaagctacctcttctagtttgcaattaggaaagaagataaagcaaacttcttggcaatttcctgcctgtgaaaccttgtgttttatgagccacggaaagtaccccaaattttttttcaaccccacccccagcaaactgacaaactcagatctttcccacccactctgtatgtctcccgtgggactgtgagagtcaagcaagtacaggttgctgtgtgctgaagccttt

SEQ ID NO: 191 - DNA, 999 bp, Homo Sapiens
  allele 501: 12-513-494 : polymorphic base G or C
  misc_binding 481..500: 12-513-494.mis1, potential
  misc_binding 502..521: 12-513-494.mis2, potential complement
  primer_bind 9..28: upstream amplification primer
  primer_bind 505..522: downstream amplification primer, complement
  misc_binding 489..513: 12-513-494 potential probe
gtgcttgacaaatacttaacctccatacaactcaattctttagctgacaataacagcacctaccttaaatatgtgcaaggatgaaatgaaataaagcatgtgaaaaatttaactcaataaaaattagttaccaataactgcattggcatggtgagttgccagtgaagagcagatagtaagtgttcaacaagcatttgtagaataaataagcgatacttgttttagtactactcagcgacagtaactctgaggccttggaagcttcagagaactgtcagctgaaatcagtgttattaatatgttgtcagtgtgtcctccaacgataagagccaactgtgttcacctcagtgatgaggttacaggatctgaagaaagtttcctagtcttatttcctgtccatcagttgacagtagtatgacatgtgagggagtgagtcgcttactctttctgtaccttagtttcctcacctgtaaagccaggatggccatgcaagtatcattsagagtaggcgtgaggtttcaataagccagattaggtgatgcacttaccacagtgcctgcacccgttaagtgctcaataaacattagccattattctctggctcagtttggaagacttacaattgcttatacagtgctctaatcacttgggggattttgagatgttgtaaagctacctcttctagtttgcaattaggaaagaagataaagcaaacttcttggcaatttcctgcctgtgaaaccttgtgttttatgagccacggaaagtaccccaaattttttttcaaccccacccccagcaaactgacaaactcagatctttcccacccactctgtatgtctcccgtgggactgtgagagtcaagcaagtacaggttgctgtgtgctgaagcctttttactggtgctatatttctttcagtttcatcaaactcagctttgtgccagttttacccaccagggccagccctcctctgaaaccaaagtttgcctatttctgt

SEQ ID NO: 192 - DNA, 1001 bp, Homo Sapiens
  allele 501: 12-515-394 : polymorphic base A or T
  misc_binding 481..500: 12-515-394.mis1, potential
  misc_binding 502..521: 12-515-394.mis2, potential complement
  primer_bind 107..126: upstream amplification primer
  primer_bind 537..557: downstream amplification primer, complement
  misc_binding 489..513: 12-515-394 potential probe
ccgagatggtgccattgcattccagcctgggtgacaagagtgaaactctatctcaaaaaaaaacatagtggtccaaggtgacctggcagagcatcagacttgctgtgaagcgacagatgtgatttgccaattgctacaatatcaaccaccagataaaaggaagttttgaaaaagaacattgggataaaatcagctcctacgaaaaagagcatgccacagtggggtagaaagtagagaagaacaaaggtcacaagggtagggagttggtgagaattagcccaaattcacccctccttttagagaactgcagcaatccacagcgtaactggcttgcattggtgcccctggccacagacctcagaagagtttagagatttccaaagttgcatttaaattttttgttttgttttgtgtcagagagccaagtccacaaagaaagttccagatcatgtctgcaaattctatttaaaccggtgttaaatagaatttgacatctgatawcttcatgaaaaatatttttcttggtttttatcagtcaaaccaaactccttccaacctttattcttccaacatttattacatggtaactgtagtccagaaactatgccaggtgttggagttataaaagtgaagaaagctacacatttcctgacttcaaggagttgacgatctggggaataagcaaaggagaggaaagacagatactcggctaattggcaaggacagcatagtggtgatagcggtgggtgggtttggggattaagcaaatgtggcttccacacaaaattctcacactctttgcaacttgcagagttaaaggataagatatttgaagcaactgccaattactaggtgttcagttaaagactgttaaagttgtattgcacagtggttaaaagtctggagtcagcctagctggacaaattctagctctaacagctctaaagtctctagctgtgtgatcgtgggaaaattacttaagccctttatgtctcagattc

SEQ ID NO: 193 - DNA, 1001 bp, Homo Sapiens
  allele 501: 12-516-97 : polymorphic base C or T
  misc_binding 481..500: 12-516-97.mis1, potential
  misc_binding 502..520: 12-516-97.mis2, complement
  primer_bind 405..424: upstream amplification primer
  primer_bind 891..911: downstream amplification primer, complement
  misc_binding 489..513: 12-516-97 potential probe
gagcatgccacagtggggtagaaagtagagaagaacaaaggtcacaagggtagggagttggtgagaattagcccaaattcacccctccttttagagaactgcagcaatccacagcgtaactggcttgcattggtgcccctggccacagacctcagaagagtttagagatttccaaagttgcatttaaattttttgttttgttttgtgtcagagagccaagtccacaaagaaagttccagatcatgtctgcaaattctatttaaaccggtgttaaatagaatttgacatctgatatcttcatgaaaaatatttttcttggtttttatcagtcaaaccaaactccttccaacctttattcttccaacatttattacatggtaactgtagtccagaaactatgccaggtgttggagttataaaagtgaagaaagctacacatttcctgacttcaaggagttgacgatctggggaataagcaaaggagaggaaagacagatactyggctaattggcaaggacagcatagtggtgatagcggtgggtgggtttggggattaagcaaatgtggcttccacacaaaattctcacactctttgcaacttgcagagttaaaggataagatatttgaagcaactgccaattactaggtgttcagttaaagactgttaaagttgtattgcacagtggttaaaagtctggagtcagcctagctggacaaattctagctctaacagctctaaagtctctagctgtgtgatcgtgggaaaattacttaagccctttatgtctcagattccttcatctgtgaaatttgagtgatagtagtaattagaccaaccacctaggattacaaagattaaatggatcgatgcatgtaagtacttagaatgacccagtacattgtaagcatatgtaaatgctagctacttaaaattaactatagtaaaatatgatatgtactgtaacaatgctagtaaaaatgctgcggactactaagtatca

SEQ ID NO: 194 - DNA, 1001 bp, Homo Sapiens
  allele 501: 12-520-287 : polymorphic base A or T
  misc_binding 481..500: 12-520-287.mis1, potential
  misc_binding 502..521: 12-520-287.mis2, potential complement
  primer_bind 216..234: upstream amplification primer
  primer_bind 653..673: downstream amplification primer, complement
  misc_binding 489..513: 12-520-287 potential probe
  misc_feature 132..133: n=a, g, c or t
tgcagtgatatgattgtgccactgtactccagcctgggcaacagagcgagaccttgtctctaaaaaaagaaaaagaaaaagaaacaaagctgatttaaaaaattgtgggcatattacaaacctgcaatgtanntgtgtgtgtgtgtgtgtgtgtgtgtctgtgtgtgcatgtaaagtacttaggacttaggacagcacacttagtatttagcacataatacctagcaatagctcaatgaatggtagcttaacaacaataactaatgatattacgacatgtttatttcatcacaccttcaccatgaataaatgtagagatctaggacctagtacctcttgctttccctttggtgctgaagcttcactccactgcttcccaaatctatgtgtccacctagaaatgggtcatggttgctgaatcgtagaataataatactgcaaaattgctaaatctctgaggggcgtgtgtgtgtatgtatgtgagtgtctgagtgtgtgtgwgagagagagagagggagagagggagggatatggggaagggaagcagtgcttgtctctttcttcttgctaaagacacttccttaaaaataaatacactggaaaataatgacaggaaactttacaaaattaaaagaggatgtcaggaagtacaggatgtgaggttgttttcatttctgtcagtattttcttattcatatatatttataactttaaaaagcagagaagttcactatttcttctacttaagatcaaatttatatataaaaaaaagacctgtgaccaaaaaaaaaagaacccacttaatactttctagctgcaattaagtatctgatctgactacattattgggcaactgaatagaatacttgtcacactcattctctatttctaaaaaatgatgcaggccaggcccaatgactcacacctgtaataccagcaatttgggaggccgaggtgggaagattgcttgaggccagaagttagagaccagcctggacaac

SEQ ID NO: 195 - DNA, 1001 bp, Homo Sapiens
  allele 501: 12-520-323 : polymorphic base A or G
  misc_binding 481..500: 12-520-323.mis1, potential
  misc_binding 502..520: 12-520-323.mis2, complement
  primer_bind 180..198: upstream amplification primer
  primer_bind 617..637: downstream amplification primer, complement
  misc_binding 489..513: 12-520-323 potential probe
  misc_feature 96..97: n=a, g, c or t
ggcaacagagcgagaccttgtctctaaaaaaagaaaaagaaaaagaaacaaagctgatttaaaaaattgtgggcatattacaaacctgcaatgtanntgtgtgtgtgtgtgtgtgtgtgtgtctgtgtgtgcatgtaaagtacttaggacttaggacagcacacttagtatttagcacataatacctagcaatagctcaatgaatggtagcttaacaacaataactaatgatattacgacatgtttatttcatcacaccttcaccatgaataaatgtagagatctaggacctagtacctcttgctttccctttggtgctgaagcttcactccactgcttcccaaatctatgtgtccacctagaaatgggtcatggttgctgaatcgtagaataataatactgcaaaattgctaaatctctgaggggcgtgtgtgtgtatgtatgtgagtgtctgagtgtgtgtgagagagagagagagggagagagggagggatatggggragggaagcagtgcttgtctctttcttcttgctaaagacacttccttaaaaataaatacactggaaaataatgacaggaaactttacaaaattaaaagaggatgtcaggaagtacaggatgtgaggttgttttcatttctgtcagtattttcttattcatatatatttataactttaaaaagcagagaagttcactatttcttctacttaagatcaaatttatatataaaaaaaagacctgtgaccaaaaaaaaaagaacccacttaatactttctagctgcaattaagtatctgatctgactacattattgggcaactgaatagaatacttgtcacactcattctctatttctaaaaaatgatgcaggccaggcccaatgactcacacctgtaataccagcaatttgggaggccgaggtgggaagattgcttgaggccagaagttagagaccagcctggacaacagagtgagaccccatctctacaaaaatatttgttta

SEQ ID NO: 196 - DNA, 1001 bp, Homo Sapiens
  allele 501: 12-523-179 : polymorphic base G or A
  misc_binding 502..521: 12-523-179.mis1, potential complement
  misc_binding 482..500: 12-523-179.mis2
  primer_bind 661..678: upstream amplification primer, complement
  primer_bind 129..149: downstream amplification primer
  misc_binding 489..513: 12-523-179 potential probe
gtactggtggaacctaatagggagcgggtacagacagaagtagacaagagaattgcttaatcattaatgcacaaaagagtatgttttaggtgtttaaaatatttcagttcaacaaggtttacatattttacaaaacccatcagaaccaggcactgtttcccaagttggcttggtattttctggtgtttcttagaagagccactgctccccaagtggacctgccctgtgacagatccctggagcccagcatttaggtacaaacagttccaggatgtgagctttatgaggatgaggattttcgtctatgttgttcactgctgtatcctcagttctaagaacagtggggcagataagtgcaaatatttattaaatgagtgtcctcaaaattgaggttaaggtcttaagagccgagtgaaacttttaccattcaggatagtgttgtgcagatatgacagatgataatagcacaaagttaccagagcctcaatttctatgtgagtratgctctctgaggctacaaaggatacaactgcatcaaggttaccttggttactagagattaatgatacacaagaagatcaagaaggaaattgtctcaatcatgcatagccaaactttacagagattaaagtcacagcactacccgagggacccagttatgttgtcactctctcggcagcaggcatccattgctccccatgctaatgttttccgtgacagtaactgctcctcttcctttttgcttctaatgttcttgacaccagcaagtaacatcccctcccctaccacatggtgtttgtctacccaaggcttataaatatttgtgcatagcttttggttattcttggctactgttttcttcattatttccaggagtcttttggttctttgttattctattgtctttgtctccttttctgtgtcactcgctccctaagagagaagatacaatgggttcaggaagtcactatcatgttggccctcataaagggaccagatgt

SEQ ID NO: 197 - DNA, 1001 bp, Homo Sapiens
  allele 501: 12-523-270 : polymorphic base G or A
  misc_binding 481..500: 12-523-270.mis1, potential
  misc_binding 502..521: 12-523-270.mis2, potential complement
  primer_bind 752..769: upstream amplification primer, complement
  primer_bind 220..240: downstream amplification primer
  misc_binding 489..513: 12-523-270 potential probe
cagccttccctgggttgacactgacatgactagccgtcagatagcttgcacttctttccacctcctgccttccagtcccctctactccccagtactggtggaacctaatagggagcgggtacagacagaagtagacaagagaattgcttaatcattaatgcacaaaagagtatgttttaggtgtttaaaatatttcagttcaacaaggtttacatattttacaaaacccatcagaaccaggcactgtttcccaagttggcttggtattttctggtgtttcttagaagagccactgctccccaagtggacctgccctgtgacagatccctggagcccagcatttaggtacaaacagttccaggatgtgagctttatgaggatgaggattttcgtctatgttgttcactgctgtatcctcagttctaagaacagtggggcagataagtgcaaatatttattaaatgagtgtcctcaaaattgaggttaaggtcttaagagccragtgaaacttttaccattcaggatagtgttgtgcagatatgacagatgataatagcacaaagttaccagagcctcaatttctatgtgagtgatgctctctgaggctacaaaggatacaactgcatcaaggttaccttggttactagagattaatgatacacaagaagatcaagaaggaaattgtctcaatcatgcatagccaaactttacagagattaaagtcacagcactacccgagggacccagttatgttgtcactctctcggcagcaggcatccattgctccccatgctaatgttttccgtgacagtaactgctcctcttcctttttgcttctaatgttcttgacaccagcaagtaacatcccctcccctaccacatggtgtttgtctacccaaggcttataaatatttgtgcatagcttttggttattcttggctactgttttcttcattatttccaggagtcttttggttctttgttattctattgtctttgtc

SEQ ID NO: 198 - DNA, 1001 bp, Homo Sapiens
  allele 501: 12-527-367 : polymorphic base T or A
  misc_binding 502..520: 12-527-367.mis1, complement
  misc_binding 481..500: 12-527-367.mis2, potential
  primer_bind 849..867: upstream amplification primer, complement
  primer_bind 352..372: downstream amplification primer
  misc_binding 489..513: 12-527-367 potential probe
  misc_feature 182,501: n=a, g, c or t
gagaaagtaggtaaaaggaaatttttttttgcattgccatactgttaaccaagactaaagaccagaagcagagaaatggaataattaaaaagtgatgacaatgtaatatttaggcatgctgtcacacagagtccaacaaaatggttttagaaattatctttaattcttttacttactggggnaaaaaataatccagaaaactataaagagataaatatttcctattatcctgttgtttgaaaataactacagttagtattttagtatatagcctattctactgttgcaaaataggtgcatttctaagaaatctcaacttatcaaaagaatgtaaagaaacaggtaacactggttgaaattggagaaggatggctggggaatagggatggaacaaaaatttctcatttagaaatactagcatgtgccttttagattttgtcctttaaaagtgtatctcctattaaaattaagccaaattgcaatttaaaactaacttttttnaaaaaaaatgttttaatgggaacagaaatgttaaaactcacagtagaacagaattttaaaaatagtaattttaacaataaatttgttttcataaccataaatgtatttggttattgctagctttaattttaaaaaggtagatcaaaacctacaaaaggaaacacaaacttccttacactttccgccacgtattcagcaccgtctaatgcctcatcactgttgccatgcaggtctgcctgcagtacagtccattacagccaggggaagcagcagctttttatcatttcccagttcccagtcagttctggttattactaacagtgattcattaaattatgttcaataagcagctaattgtgctatgtccaatttttgttagggacactttaactgtaggagaaattaatgcctgtataattttccaaatgctttccccaggcgtgtatacatatactttatatagaagttatctttttaaatttgtttttaccaaaaaaaga

SEQ ID NO: 199 - DNA, 1001 bp, Homo Sapiens
  allele 501: 12-529-376 : polymorphic base T or C
  misc_binding 481..500: 12-529-376.mis1, potential
  misc_binding 502..521: 12-529-376.mis2, potential complement
  primer_bind 856..875: upstream amplification primer, complement
  primer_bind 349..369: downstream amplification primer
  misc_binding 489..513: 12-529-376 potential probe
  misc_feature 389,501: n=a, g, c or t
gtaaagtggtgcaattatggctcactgcagcctcaacctccctggcaagcctccaacttcagcctcctgagcagctgggactgcaggcacacaccaccacacctggctaattaaaattttttttttttgtagagacagggtcttgctatgtcacccagactggtctcaaactcctgagtcaagcaatcctcctgcctcggcctctcaaagtactggaattacaggtgtaagccactgcacctggccttttctatttttaaaatccatttgtttattatcttttttcatctaactaaaaggcaaacctccaccatggcagggaacctcattggtcttggcctatatcttctgttcctagagcaactcctgaaatgaagtgggtgctcaangtattaattaataggaaggaggaaaaagaagggagcctagatctgaggcataagccatattctgccttgccatcagggaatggagttatcttcttttctgtggaggacatangggcatctgagaagcagatggcaagatggaatttgatgtacaggagatttattttgagaaacacctgtgaaggataaagaggcgaagagcagggtaggtggggtgaaccttcagactgcagtggtggcctgacccctatgagaggagagaggagaggaagtaggctgagattaggaagagcctcagtgcatagtgaagctccgagaaaaccttggtaggctgttggggagcccctgagcaaagactgccctttggaggagttctgtgttgggcgcaagtccagtacccctgttgtttacagtcattgactgacagccacctggagagggcatgacctcagtgtgaactttggtagacccaaaggtgtggcagttggaggctgttagctaactgcgttctttgcagctgattctcttgaagtgaaatctgagcattgtttctctatggctacccaaaggggagggtttagcaggtgtaattgtaaggattagattcaccaa

SEQ ID NO: 200 - DNA, 1001 bp, Homo Sapiens
  allele 501: 12-529-489 : polymorphic base T or C
  misc_binding 481..500: 12-529-489.mis1, potential
  misc_binding 502..521: 12-529-489.mis2, potential complement
  primer_bind 968..987: upstream amplification primer, complement
  primer_bind 461..481: downstream amplification primer
  misc_binding 489..513: 12-529-489 potential probe
  misc_feature 501,613: n=a, g, c or t
ttccattaattcactcaaatatattttcttaactgcacttattactgtctaaaagtatcttgtctatttatttgtttttgagacaaggtctcgcttcattgcccaggctctagtaaagtggtgcaattatggctcactgcagcctcaacctccctggcaagcctccaacttcagcctcctgagcagctgggactgcaggcacacaccaccacacctggctaattaaaattttttttttttgtagagacagggtcttgctatgtcacccagactggtctcaaactcctgagtcaagcaatcctcctgcctcggcctctcaaagtactggaattacaggtgtaagccactgcacctggccttttctatttttaaaatccatttgtttattatcttttttcatctaactaaaaggcaaacctccaccatggcagggaacctcattggtcttggcctatatcttctgttcctagagcaactcctgaaatgaagtgggtgctcaangtattaattaataggaaggaggaaaaagaagggagcctagatctgaggcataagccatattctgccttgccatcagggaatggagttatcttcttttctgtggaggacatangggcatctgagaagcagatggcaagatggaatttgatgtacaggagatttattttgagaaacacctgtgaaggataaagaggcgaagagcagggtaggtggggtgaaccttcagactgcagtggtggcctgacccctatgagaggagagaggagaggaagtaggctgagattaggaagagcctcagtgcatagtgaagctccgagaaaaccttggtaggctgttggggagcccctgagcaaagactgccctttggaggagttctgtgttgggcgcaagtccagtacccctgttgtttacagtcattgactgacagccacctggagagggcatgacctcagtgtgaactttggtagacccaaaggtgtggcagttggaggctgttagct

SEQ ID NO: 201 - DNA, 1001 bp, Homo Sapiens
  allele 501: 12-530-134 : polymorphic base A or T
  misc_binding 482..500: 12-530-134.mis1
  misc_binding 502..521: 12-530-134.mis2, potential complement
  primer_bind 369..389: upstream amplification primer
  primer_bind 798..817: downstream amplification primer, complement
  misc_binding 489..513: 12-530-134 potential probe
  misc_feature 735: n=a, g, c or t
ccctgttacccccctttaagcaggggagatggactgtacttaggtgtgaaaacagtgctcaaaacaatatcaataggtaatgtctgtaagaggctaagttctagtgttccatcgccctgtaggataactatagttaacaataatatagtttcaaatagctagaaggaggatattgaatattcctaaaacaaaaaaatgttacatgtttgagatgatgggtatgcaattaccctgatctgattaccatacattatatgtattgaaacatcactatgtaccttatgaataagtacaattattatttgtcagaaaaaataagtctaatgtattgccacacttagggttttcttttctttacttgttgccagaaaattgcttctgatgccacctagttccacattctcaccagagacaaatgaccagccactgtcctcccttccccttcctcttggagctctttgggagttactgagaggcaagacaccgaggaagagagcaccwcccactgaagctgggcgtgaatttataagggttcctcttcctcttcccttaccccaatctaagcattgaaagcatggcggatctaggaaatgcatttgaatacagttcctaactgtggcactcatggaatcctcccatttggctctccttcaaaaaacctctacaaaacagaacaatttgggagtaattagaaaatgcagattaatattcatagaaatattttcaacacttctngtttattccctgtggatggacatgttttgtctgattttgatacatatgttcatctttcactaggtgactttagagaaagagaaaaaaagtatttcacatttttccccttggttttttgattttaggagctgaaagatgacttgaagggtgatctctctggccactttgagcatctcatggtggccctagtgactccaccagcagtctttgatgcaaagcagctaaagaaatccatgaaggtatgagccccccacaagccatttctg

SEQ ID NO: 202 - DNA, 1001 bp, Homo Sapiens
  allele 501: 12-530-393 : polymorphic base C or T
  misc_binding 481..500: 12-530-393.mis1, potential
  misc_binding 502..521: 12-530-393.mis2, potential complement
  primer_bind 110..130: upstream amplification primer
  primer_bind 539..558: downstream amplification primer, complement
  misc_binding 489..513: 12-530-393 potential probe
  misc_feature 476: n=a, g, c or t
ttgaaacatcactatgtaccttatgaataagtacaattattatttgtcagaaaaaataagtctaatgtattgccacacttagggttttcttttctttacttgttgccagaaaattgcttctgatgccacctagttccacattctcaccagagacaaatgaccagccactgtcctcccttccccttcctcttggagctctttgggagttactgagaggcaagacaccgaggaagagagcacctcccactgaagctgggcgtgaatttataagggttcctcttcctcttcccttaccccaatctaagcattgaaagcatggcggatctaggaaatgcatttgaatacagttcctaactgtggcactcatggaatcctcccatttggctctccttcaaaaaacctctacaaaacagaacaatttgggagtaattagaaaatgcagattaatattcatagaaatattttcaacacttctngtttattccctgtggatggacatgytttgtctgattttgatacatatgttcatctttcactaggtgactttagagaaagagaaaaaaagtatttcacatttttccccttggttttttgattttaggagctgaaagatgacttgaagggtgatctctctggccactttgagcatctcatggtggccctagtgactccaccagcagtctttgatgcaaagcagctaaagaaatccatgaaggtatgagccccccacaagccatttctgcccagggtttgaccaagtcatcaaaaatagtgactttcttgcagtgcacacttgtgatgggtggacttggatgcccttttggtctggactctcccagtggtagaatgactctgaaataggcaacagctatagaaccttaagcccaaatgttcctgggctggaagaattttgtcatatcctttgtttgacatgaagagtcaagttctctaatttgtcatcgttgaaagtaaatagcactatgattaaccccaacactcaa

SEQ ID NO: 203 - DNA, 1001 bp, Homo Sapiens
  allele 501: 12-531-173 : polymorphic base C or T
  misc_binding 481..500: 12-531-173.mis1, potential
  misc_binding 502..520: 12-531-173.mis2, complement
  primer_bind 329..346: upstream amplification primer
  primer_bind 723..741: downstream amplification primer, complement
  misc_binding 489..513: 12-531-173 potential probe
  misc_feature 326: n=a, g, c or t
ctaccttggggaatattgagaaataaaatccaagtagcaagatgagttcagttgaaagagagctttgagatcagcgaattcactcattcaattaaaaatattatcaaatgcatattatgtgctaggctcagggttacaattataagcaaagggggtagggtgggggaagacattttctgcccttatggaattacaactatgttaaatgtaaaggaaagtgacattgtgctaaaagatcctacaatagtaggacttgacttagaggaaaggcttctatgagaaagtcatgattcagatctggaaaataagtagatattaataaggcnaaaatgtatggaggtaagggagccagtagaacattctaataaaagaaatgacaaatggaaaggcctcatggtggaggaagcataatgaaaaatgaggatgtgggggccagatcatgcaggacctttttggcaatgtttaaggaattttggctttagcttaagagtaaggggaagycattgaagagttctgggcatgagctcttgaagagttagtatcaggatcatgaaaagatccctgtaagatcttcttattctggagaataagaagggctcaaaagatatttaggagttgaaacttaagggacttggtataatatcttggtgtgaggaaaggaagatagcaaggatgacactcaagttcctaacttggaaaacagacagtggcgccattccttgcaagaggatcaggttttaggttgtttgtttgtttgtttgtttccttttcttttgggggagtggggggaggtttatgagtttggttttacatgtattgagtttgagatgtctttgagccatgtaagacatgtggagaggtcaagtaagtcattagcggtgtaaatatactttgagttacttggatgtattttcttgactaactggtagaacgcctaattgtttacaactctgatcagagatgtctagaaggagctcttttaatacaaagctggagcattg

SEQ ID NO: 204 - DNA, 1001 bp, Homo Sapiens
  allele 501: 12-539-441 : polymorphic base C or T
  misc_binding 481..500: 12-539-441.mis1, potential
  misc_binding 502..521: 12-539-441.mis2, potential complement
  primer_bind 62..79: upstream amplification primer
  primer_bind 567..587: downstream amplification primer, complement
  misc_binding 489..513: 12-539-441 potential probe
tgaggcatgatctatgctgcccctgagacccccaggaagtctgagccccagctgcccgcagtgacaactgactcacaacacaccctgtaccggctttctttctttttctgtctcacttctgcactcacttcccagtgcttcctgggatccctggatccttttctcagcatctgtttctggagggacacatcccaaaataggaaggactattttcagtagtcactataaagtaggaggtgtaactgtgtgtaactttgtggggttacagggtggaggagttgagagaagaaaacggaggcttttagggtagaaatcctctagaacagtgattctctgtgttggcgtgctagggagtcaccaagtgttttggaagtgaaatggagaggtaggaggagcactggggtggctcaagttagatggctctgggaaggaaatgagccacagcttcaaagttccacctctttcttcaaagcacagttacctggaaacacaaacgaaaaygaatgagaggaagatgaagaataggagcaataagaagaggaggaggaaatcccatctaattttatctaccacattgccaccttattactactttacatttatttccatgggttctttggaagtgaagtccagaatttaggggcacacagggagtctatgattctagtaagcaaggcaggaagcagtgaaggcaaatagaattagtgaatgaaatgggatagatcatgtgacgcaggaggggttccagggaagctagagatgggcttcctgggtggggtgaaggagatgacaggctgtggctgcaaatgggataatagatctcagaaacagagattaccctgagtgttaacgacactgactaaggcaggtcaaaggtggaggtcttcaacccaggaaatacctctggggtaaaggaatctaaaaggttaatgtggattccagagtcaatatagattatggcaaagggcagggcagaggagcaggactgagtccgctgctga

SEQ ID NO: 205 - DNA, 1001 bp, Homo Sapiens
  allele 501: 12-543-78 : polymorphic base G or A
  misc_binding 481..500: 12-543-78.mis1, potential
  misc_binding 502..521: 12-543-78.mis2, potential complement
  primer_bind 558..578: upstream amplification primer, complement
  primer_bind 130..150: downstream amplification primer
  misc_binding 489..513: 12-543-78 potential probe
gtactatccgaagttcaaaactatagactgtgccacagcggggcacatgtgcaagggcagagttggagccctgaataaacagttcaccattacttacagaatttccctggttccatgtttccccctttcttttttggggggaaggatgtgaatttttcttctttttctccagcagtagcagtactgaaaccattcagcaacgaggatttggcagcttctaagggtcatgtcgttggtgggtgcagtttgagttgaagtgattgcagacgtgcagacaaacacacagaaatagaggttcagtagggcctgggcctaagccctggggaaagctacagttacttcagtggaaggggagtaggagccaacagagcaaatggaaggaagagcaggaagatgatgccgcactccggaggagaagcagcagagttgctctctgtacctgcaagccaatggagaagtttatcataagacagtaatgaactaataacacaccgctgacgrgtgacacacagcaatagtggcaactgttgaagaactactgtgtgctcagcgtcacgctacatgctttagagaagcccttagggcacagtggagttagaagtacgttatttattaggaatgactgtacataggataaaaaaaaaaagaaataggtcatttatcctaactcttacagcaactagctttgagaaagtgagcagcttattcaatctctctgagtattagtttcatctgagaaattggagtaataatatccatattactcatttagcctatcaatgtgaactgaaagcctactgtgtgctaaacactactctaaaagctgcatatacatgtaaaaatttactacctgttgggctgggcgcggtggctcaagcctgtaatctcagcactttgggaggccgaggcggatgaatcacttgaagtcaagagttcgtgaccagcctgaccaacatggtgaaacccagtctctactaaaaatacaaaaattagccgcgcat

SEQ ID NO: 206 - DNA, 1001 bp, Homo Sapiens
  allele 501: 12-543-79 : polymorphic base C or G
  misc_binding 481..500: 12-543-79.mis1, potential
  misc_binding 502..521: 12-543-79.mis2, potential complement
  primer_bind 559..579: upstream amplification primer, complement
  primer_bind 131..151: downstream amplification primer
  misc_binding 489..513: 12-543-79 potential probe
tgtactatccgaagttcaaaactatagactgtgccacagcggggcacatgtgcaagggcagagttggagccctgaataaacagttcaccattacttacagaatttccctggttccatgtttccccctttcttttttggggggaaggatgtgaatttttcttctttttctccagcagtagcagtactgaaaccattcagcaacgaggatttggcagcttctaagggtcatgtcgttggtgggtgcagtttgagttgaagtgattgcagacgtgcagacaaacacacagaaatagaggttcagtagggcctgggcctaagccctggggaaagctacagttacttcagtggaaggggagtaggagccaacagagcaaatggaaggaagagcaggaagatgatgccgcactccggaggagaagcagcagagttgctctctgtacctgcaagccaatggagaagtttatcataagacagtaatgaactaataacacaccgctgacsggtgacacacagcaatagtggcaactgttgaagaactactgtgtgctcagcgtcacgctacatgctttagagaagcccttagggcacagtggagttagaagtacgttatttattaggaatgactgtacataggataaaaaaaaaaagaaataggtcatttatcctaactcttacagcaactagctttgagaaagtgagcagcttattcaatctctctgagtattagtttcatctgagaaattggagtaataatatccatattactcatttagcctatcaatgtgaactgaaagcctactgtgtgctaaacactactctaaaagctgcatatacatgtaaaaatttactacctgttgggctgggcgcggtggctcaagcctgtaatctcagcactttgggaggccgaggcggatgaatcacttgaagtcaagagttcgtgaccagcctgaccaacatggtgaaacccagtctctactaaaaatacaaaaattagccgcgca

SEQ ID NO: 207 - DNA, 1001 bp, Homo Sapiens
  allele 501: 12-546-235 : polymorphic base C or T
  misc_binding 481..500: 12-546-235.mis1, potential
  misc_binding 502..521: 12-546-235.mis2, potential complement
  primer_bind 267..284: upstream amplification primer
  primer_bind 795..815: downstream amplification primer, complement
  misc_binding 489..513: 12-546-235 potential probe
agccccacatctgctccccttcccctgttcagtcatcccagagaatggccccaacaggaatttgcccaactctctgaagtcgtaccattcctccccagacttcttgactatgcctcagccaccccaggcttctttccattcctcaactgtggcaagtctattctcacatcacagtctttgcatccattccttctctggaatgctcatcctctagatctttacctagctgactccttctcatctttcaggtttcagctctcctcctgagagaggtctcccctaactgtaccaggccaattggttccctttcagtcactctccatgccatttccagctttcttttcttcatatttctgatcactatttacttaagcaatagttaatttgctttgctgtctgtctccatctactagaacataagctccatgcagacagagatataatctgttctgttcaccgccattggcacagcacatggaataatgcctggctatagtcgaygctcataagcatttgctggatgaattacatagatgaatggaatatcatttagtatgttggccatcattaggtcaaaatccacctaactgctcagctagaaattttacactatctctctttttcattatcctgtagcgatacatcattatgttttgtcaatccatttacataagcaactctcaaatcttcccattttctccatccctactgcctttattctaaggatggccatcatcatctcttaattactcagtctcctcaagatgagtctcaaagcctctagtcttaactcccttatcttccttctactcctaccttgcaatctgtttctcatgctgcagtcaaagtgattttctgaaaccacgaatttgatctgatctcaacattctcatgtttaaaatattacaagagctctccacacttaggataaagtcagaatttcatttcatggttaacaaggtctggcctttccagacacatttctttttatccctctttgt

SEQ ID NO: 208 - DNA, 1001 bp, Homo Sapiens
  allele 501: 12-549-287 : polymorphic base T or C
  misc_binding 481..500: 12-549-287.mis1, potential
  misc_binding 502..521: 12-549-287.mis2, potential complement
  primer_bind 770..787: upstream amplification primer, complement
  primer_bind 304..324: downstream amplification primer
  misc_binding 489..513: 12-549-287 potential probe
  misc_feature 32,128,132..135,200: n=a, g, c or t
tgagtcacgagaattgctggaacccaggaggnggaggttgcagtgagccaagatcatgccactgcactccagcctgggtgacagagaaagattccaaaaaaaaaaaaagaaagaaagaaaagaaaagnaaannnngacgggaaggaaggaaggaacggagggagggagggagggagggaaagatacacgtcctgtggccncagtacaaggacatttttcttggttgggaaaaattcaggggtgccttattttatgctgatgttcaaatcaatattctaagttataataaggctgttacattagactcttaacacagtaatcttcaaaaagtaatgctatattattaaataagtgtacataaaataacttactggtcattctcttcttagtccaaggattttgtcactaacctgctaaaattcttttagcaagacttttaattagaggtcaaaaatttactcactctaatgagggacttgaattttacaatctgtaataacygacttgacgttgggccttattatctcggattctttcatcttccttgggttgttccttaattctgggcattttgctgcccattacctctctcttcaaaggttggcaaagggacatagcaacaattctggtaaacagagcaaatggaaatggaaatgagccagaggtgtgctcagtagaatgtcatgtcatgtattgatcaaatggcacagagaacccaggctctggagtcaagactgggaagctattgtcataaactattctacattggcccgtaacttgagccttaacaaatcatacaacctcagagacttcatctataaattgaaagtgttaatatcatataccttttaagattttttggccagatgcagtggctcatgcctgtaattccagcacttcgggaggatcacttgagctcaggagttagagaccagtctgggcaacatagtgggaccctgtttctactaaaaataaaaaaaaaaaactaggcaagtgtggtg

SEQ ID NO: 209 - DNA, 1001 bp, Homo Sapiens
  allele 501: 12-550-287 : polymorphic base A or G
  misc_binding 481..500: 12-550-287.mis1, potential
  misc_binding 502..521: 12-550-287.mis2, potential complement
  primer_bind 216..234: upstream amplification primer
  primer_bind 712..731: downstream amplification primer, complement
  misc_binding 489..513: 12-550-287 potential probe
cacaagtatacagtcttcaaattaagtataatttggcctgaaatcacattgtccattagtaaaatattccattgtattcatttgaggagctttctctcctccatgggtcaaaacaagcatcccaggattatgttcatccccaaaaataggatagaggtgtgagtttgcttaattggctacttgctgctccctgacacaggtccctgtcctcttccatgtggactatgtgccctgggtaggctcagcggtcctctctactgatcacaggctgactgtgcctccacctgcagcagcgtgccatagaattctcttccattggtctcgctttagccttaacttggaaagaacccttccttacttccctccctgcctggaagatcccacagtgctggccttttctgaaaaaagatgctcatcttttgttttttaattgcttcatagttcacctttttataaaagggaaagcaaagaggcattaaacagcgtgactcactgggaaarctagtatttcagccagacagaagagttcattggaggatgggaagttcagaggaatatggctggggggatgaacacctgattagaagggtttgtagggtattagaataagtttgtatttatctaggcattgaggaaaccggggtcattcaaggctttacacagaacagtagcaaaattagattttcctttgaaaaggaaactctgatgctggtagggagagtggttgaaggggagcaaggctggaagcagtgataccagttaggagaccatggcagtagttcaagaaagagatgttgtgaacctagtgccttaatcctctgctgaatctgagagtctcctctccattggcctgtgactaggaccataggccaatctcctactataaaagataaaaaggctgatacaaacatttctaggcttgcttgcagcttgagttaagacttaataaggtgatattacaattcattctggcagtgctggcagaggaaacagcagcaatg

SEQ ID NO: 210 - DNA, 1001 bp, Homo Sapiens
  allele 501: 12-552-175 : polymorphic base G or A
  misc_binding 481..500: 12-552-175.mis1, potential
  misc_binding 502..521: 12-552-175.mis2, potential complement
  primer_bind 659..674: upstream amplification primer, complement
  primer_bind 188..207: downstream amplification primer
  misc_binding 489..513: 12-552-175 potential probe
  misc_feature 658,838: n=a, g, c or t
tacctcctggcagaaaacccagccatcacctcagaccccagcccagctcctctttcattcctctctcatcttcttcactttcaaccatgaacttacctgtccttcatacaagagtcctaataatataaaatagtgtctataatttattgagtgttattataacttcatgctaagaatcaacacatatcttctcattttaatcctcccaacaatgcttttagttgcatataatcactattttacagacataaaaaatgaggattgcacaggaacagccgagccaggatgttaacatttgtctgtctggccttcttttgaccaggggtctttctttcctcagtttttctttcgccctgactttgttctctgttaggtctggattcctagcaccatcaggcgacctgctctctctccccatataatcgcttggatttcttctgatagtgcccaagcaagcccttaacagtttccctttgttgtcatctgcacggacaacctgtrtgatcagacatgcccatcagtttcttcctgaatctttactctcaatacctgtcaatccagtgcagcccaacttagaagctcctctgcctgtctccagtaacctgcagcatcagatgattccagtttgaatgggaaaatgctttgtttctcttgactnaaaaaactgggactagcagggcatatttgtgttttcaaagaagaatgtatcagtccaagaaagtttctaatgcaagtaaattttctaattagcaatggtccccaatctttttggcactagggaccagtttcctagaagagaatttttccacagacaggttgggggtgaggatggggttancggttttgcaatgaaacatttccacctctgatcatcaggtactagttacattctcataaggagcacacaacctagatcccttgcatgagcagttcacaatacggttcatgctcctgtgagaatctaatgccactgctgatctgatgggaggcagagctcaggc

SEQ ID NO: 211 - DNA, 1001 bp, Homo Sapiens
  allele 501: 12-554-330 : polymorphic base G or T
  misc_binding 481..500: 12-554-330.mis1, potential
  misc_binding 502..521: 12-554-330.mis2, potential complement
  primer_bind 172..192: upstream amplification primer
  primer_bind 645..663: downstream amplification primer, complement
  misc_binding 489..513: 12-554-330 potential probe
  misc_feature 501: n=a, g, c or t
tgtaaggattagattcaccaataagtattagaacagtttctcttttacataaaagaaatccaggctgtggtggcaccaccattatcagagactcagtctccttctatcttgaggctctgccgtctttaactcatggttttcacttcctggctaaagaaggctcatgactcagccattatgtcttcattccaggcaactcaaaagagtaaaggacaaagaagggttcactccctcactctaaggatactccctgagcatacatatggtacttctgcatatatcccattggtcagagtttagtttctggacatatttcactgtaaaagaagctgagaaacatagcctttatatgggtagcaatgtaccaagttaaaagttgggggttccattactaagcaagaaagacaaaagagatactgtggtaaactaggaatctctgctacagagagacagaattcagtctctgttcatatgctgcactggccttattcaatcaagtcntagtgtatatgacttttcttggagtcacagtgtgattcagtgaccttgatataaacaggactgagaggtaattagtccccatgccagccaggcccatgatgcacattactgaggatttgaaaggctccctgtatgaagagaatgatacatgctgatagacccagtacagtgatgcaaggatgaaatcattcaaaagtattatagagccttttctaaacatagtggaatgtttgaatgttggtagggttaatcctgttagactgtcacttctaatcttgaatgacacaggctttttcttttatactatttctttccagaattattcaattgattttcacactagagtgaaaaatttgctgtcactttattccagatgatttatgttattactaaaatatatggaaaaatagaaaacgagagcaatagagaaccttgtattgatttacttaaaagtgtcctttcatctatataaacaagataataagaccaaaaggcatgag

SEQ ID NO: 212 - DNA, 1001 bp, Homo Sapiens
  allele 501: 12-556-312 : polymorphic base A or C
  misc_binding 481..500: 12-556-312.mis1, potential
  misc_binding 502..521: 12-556-312.mis2, potential complement
  primer_bind 194..214: upstream amplification primer
  primer_bind 674..693: downstream amplification primer, complement
  misc_binding 489..513: 12-556-312 potential probe
agctgcagtggattttgctctcggcaatctctcattaattgaattaaccattgtcatcaatgtaagagactcaaatcgtattttatttttaggcgttagaaatcactcagattagatccacgattttgggtgtgggaaattagattaatttagaggatgtgttgagcataaggattcaatagaagtagctaaagacctaatagtctgctggctgtgtaaaattagaaagactctgaaatgtaattctgactgtaactacccagggttagtgtgacttcacaggttaaggtcacagtccccacaagactaccttcacctcagacaccagcccacaagctcaggtgttttcaggctacacgtgcttttaaccagctggctacaaattcagggttctcactaccctctcaggttgaatagcacactagaatgacacagaactcaagaaagtgctgtgttcacaaatgcgatattatcataaaggaaacaaatcagggccaatcmaatgtggagactgcatatggagatatttggaagggtccagtggaagcttccactctcctgaccattgatatatcattaccaaccagcaagctcacttgattattggtagccttagtttttattggggttttgttatataagcatgattggttgaaccattgttcatgtgattgaaccagtccacctacactccccagaggtcaggctgatattgtggctcaaagcctcaaccttttaatcatatggttgatctttctgatgtgaccagcctttattctgggtcatattgttagcataactgagctgtagtccaagagaccaaccatgaataacaaggacacacctatgacttgggaaatccaaagaatttagagtttacctcccaggaatcaggaataagaccagcccaattctctactattcaatggccccatagaaccctctccaagtactttaagggagccacagtttctctgtttgtgtctcacagaggtcagttg

SEQ ID NO: 213 - DNA, 1001 bp, Homo Sapiens
  allele 501: 12-556-443 : polymorphic base C or T
  misc_binding 481..500: 12-556-443.mis1, potential
  misc_binding 502..521: 12-556-443.mis2, potential complement
  primer_bind 63..83: upstream amplification primer
  primer_bind 543..562: downstream amplification primer, complement
  misc_binding 489..513: 12-556-443 potential probe
gtgggaaattagattaatttagaggatgtgttgagcataaggattcaatagaagtagctaaagacctaatagtctgctggctgtgtaaaattagaaagactctgaaatgtaattctgactgtaactacccagggttagtgtgacttcacaggttaaggtcacagtccccacaagactaccttcacctcagacaccagcccacaagctcaggtgttttcaggctacacgtgcttttaaccagctggctacaaattcagggttctcactaccctctcaggttgaatagcacactagaatgacacagaactcaagaaagtgctgtgttcacaaatgcgatattatcataaaggaaacaaatcagggccaatccaatgtggagactgcatatggagatatttggaagggtccagtggaagcttccactctcctgaccattgatatatcattaccaaccagcaagctcacttgattattggtagccttagtttttattggggtttygttatataagcatgattggttgaaccattgttcatgtgattgaaccagtccacctacactccccagaggtcaggctgatattgtggctcaaagcctcaaccttttaatcatatggttgatctttctgatgtgaccagcctttattctgggtcatattgttagcataactgagctgtagtccaagagaccaaccatgaataacaaggacacacctatgacttgggaaatccaaagaatttagagtttacctcccaggaatcaggaataagaccagcccaattctctactattcaatggccccatagaaccctctccaagtactttaagggagccacagtttctctgtttgtgtctcacagaggtcagttgtgtcatagcagcttttgcagtgggagaggtccaaagaaggagtacatattggtcctcatgtaggtgttaaagaggatgctttgggagattcttgttagaaggtaaatacctcaatgtcaggtgactgtttt

SEQ ID NO: 214 - DNA, 1001 bp, Homo Sapiens
  allele 501: 12-558-205 : polymorphic base C or G
  misc_binding 481..500: 12-558-205.mis1, potential
  misc_binding 502..521: 12-558-205.mis2, potential complement
  primer_bind 687..705: upstream amplification primer, complement
  primer_bind 236..256: downstream amplification primer
  misc_binding 489..513: 12-558-205 potential probe
atttcactaatttctctccctcttgaagaagagtatgggaatgcaattgaatgagagtataatattataggatattgtacttaagatccttctgtatgataaagacagaaaatcctacttatgcaagggaggaaatttactggattgtgtaactgaaaatccagggatagtatgggctttaggcacagctggattcagggttcaaaatgtatcactaggtcatggatttccttcatctttcagctctgccttccacagattggttttagtctcaggttctacatgggagcaagctgactaaacagaagtgccagcttcctattgtcccaggttcaagtccactgggaaagagtgcctgcctggaggatgccagactctcattggccagagtgcctctgggaaggggatggggaaggggaaaatcccataaccactggcattgagtacagggatggagtaaatcactaattaaaaagtggaaagtgtaacaaagaatgtcasaaggaaaggccaagtaaccagaatgttcataaaatagggaaaacttaatatctgttcatattcaaattcactgcattgaatattgtgtgacatcccataacagaggagatagcaatgtgttttcaccaaggttgagaggacgggcaacattgggctggtggaaaggaatatagaactacgcttcaggatcgctgagtaatcatcttgtttgaccactaagtttctcatgtgatactgagtaattcatctcacctttcaggttctcaggcttttttttttttttccatctgttaaacagaattgcctgtgttacttatcttactgggttactgtgtagctgaaatcaaataaaacatttaataatagttttattaatttatcatgagacatatttccaaacagatattatgtattttgtttcaataaaggatgatgaggcaaatctacccagtgatttttcacttctgagggttgtgcagttcttgaattcctgactgcaa

SEQ ID NO: 215 - DNA, 1001 bp, Homo Sapiens
  allele 501: 12-558-238 : polymorphic base T or C
  misc_binding 481..500: 12-558-238.mis1, potential
  misc_binding 502..521: 12-558-238.mis2, potential complement
  primer_bind 719..737: upstream amplification primer, complement
  primer_bind 268..288: downstream amplification primer
  misc_binding 489..513: 12-558-238 potential probe
tatgcagtgtaactctctgggaaatagctataatttcactaatttctctccctcttgaagaagagtatgggaatgcaattgaatgagagtataatattataggatattgtacttaagatccttctgtatgataaagacagaaaatcctacttatgcaagggaggaaatttactggattgtgtaactgaaaatccagggatagtatgggctttaggcacagctggattcagggttcaaaatgtatcactaggtcatggatttccttcatctttcagctctgccttccacagattggttttagtctcaggttctacatgggagcaagctgactaaacagaagtgccagcttcctattgtcccaggttcaagtccactgggaaagagtgcctgcctggaggatgccagactctcattggccagagtgcctctgggaaggggatggggaaggggaaaatcccataaccactggcattgagtacagggatggagtaaatcactaaytaaaaagtggaaagtgtaacaaagaatgtcacaaggaaaggccaagtaaccagaatgttcataaaatagggaaaacttaatatctgttcatattcaaattcactgcattgaatattgtgtgacatcccataacagaggagatagcaatgtgttttcaccaaggttgagaggacgggcaacattgggctggtggaaaggaatatagaactacgcttcaggatcgctgagtaatcatcttgtttgaccactaagtttctcatgtgatactgagtaattcatctcacctttcaggttctcaggcttttttttttttttccatctgttaaacagaattgcctgtgttacttatcttactgggttactgtgtagctgaaatcaaataaaacatttaataatagttttattaatttatcatgagacatatttccaaacagatattatgtattttgtttcaataaaggatgatgaggcaaatctacccagtgatttttcacttctga

SEQ ID NO: 216 - DNA, 1001 bp, Homo Sapiens
  allele 501: 12-558-305 : polymorphic base T or A
  misc_binding 481..500: 12-558-305.mis1, potential
  misc_binding 502..521: 12-558-305.mis2, potential complement
  primer_bind 786..804: upstream amplification primer, complement
  primer_bind 335..355: downstream amplification primer
  misc_binding 489..513: 12-558-305 potential probe
tgcagctaactcctagtgaagtgactttcagtttagtttcgttttgttgtagccaatcctattgttatatgcagtgtaactctctgggaaatagctataatttcactaatttctctccctcttgaagaagagtatgggaatgcaattgaatgagagtataatattataggatattgtacttaagatccttctgtatgataaagacagaaaatcctacttatgcaagggaggaaatttactggattgtgtaactgaaaatccagggatagtatgggctttaggcacagctggattcagggttcaaaatgtatcactaggtcatggatttccttcatctttcagctctgccttccacagattggttttagtctcaggttctacatgggagcaagctgactaaacagaagtgccagcttcctattgtcccaggttcaagtccactgggaaagagtgcctgcctggaggatgccagactctcattggccagagtgcctctgggawggggatggggaaggggaaaatcccataaccactggcattgagtacagggatggagtaaatcactaattaaaaagtggaaagtgtaacaaagaatgtcacaaggaaaggccaagtaaccagaatgttcataaaatagggaaaacttaatatctgttcatattcaaattcactgcattgaatattgtgtgacatcccataacagaggagatagcaatgtgttttcaccaaggttgagaggacgggcaacattgggctggtggaaaggaatatagaactacgcttcaggatcgctgagtaatcatcttgtttgaccactaagtttctcatgtgatactgagtaattcatctcacctttcaggttctcaggcttttttttttttttccatctgttaaacagaattgcctgtgttacttatcttactgggttactgtgtagctgaaatcaaataaaacatttaataatagttttattaatttatcatgagacatatttccaaaca

SEQ ID NO: 217 - DNA, 1001 bp, Homo Sapiens
  allele 501: 12-769-39 : polymorphic base G or T
  misc_binding 481..500: 12-769-39.mis1, potential
  misc_binding 502..521: 12-769-39.mis2, potential complement
  primer_bind 463..482: upstream amplification primer
  primer_bind 899..918: downstream amplification primer, complement
  misc_binding 489..513: 12-769-39 potential probe
  misc_feature 483: n=a, g, c or t
ggatttgctcctagtgaaggagaaggagggtgtcctgcatgtccctatcactcggagcggagacctgagctatgagtcatcagtgaggtgctatactcagagccattccgctcaggtcatggaggactttgaggagagacaaaatgcagactcttcacggattacatttctcaaaggggacaaagtaagtggattggtggtggctgaaagatgagattctcttattgtctttatttgtctgtaatgaagtcatttatataaattccaaaaattctcagaattttgtatactacaggtgacccttgaacaatgcaggggataggggtgccaactccccacacagttgaaaatttgtgtataacttttgactcacacaaaacttaactactaataacctactgttgactgaaagccttaccaataacataagtagttgattatcacatattttatgtgtcatatgtatcacatgctgcattctcncaataaaataaactagakaaaaaatgttattaagaagtggaatagtggatcatcataaaggtcttcatcctcattgtcttcatattgaataagctgaagagaaggagggagaggagggtctcactgtctcaggagtagagagacagaaaaaaatccatgtctaagtgcacccatgcagtttgaacctgtgtcattcaagggttatccataattgacaatatttttaatgatgtcatctattccttctttgtctcccacttacaatcaaatacacatatcattggttgatctgagaagtttagctgatgtgtgacatatttggaacttagcagaagcaaatgagttctgctcttattaccacctcttaatctcaaactatgttagagatgaatatactccactgttactttgagagcaggaggcagccgtctaatacctgcacccctgtcccagggaaacatatatcccagtataggaccaaataggcagatgttgagcaaattgaagtcagcagagta

SEQ ID NO: 218 - DNA, 1001 bp, Homo Sapiens
  allele 501: 12-769-430 : polymorphic base C or T
  misc_binding 481..500: 12-769-430.mis1, potential
  misc_binding 502..521: 12-769-430.mis2, potential complement
  primer_bind 72..91: upstream amplification primer
  primer_bind 508..527: downstream amplification primer, complement
  misc_binding 489..513: 12-769-430 potential probe
  misc_feature 92,680,705..706: n=a, g, c or t
taacctactgttgactgaaagccttaccaataacataagtagttgattatcacatattttatgtgtcatatgtatcacatgctgcattctcncaataaaataaactagataaaaaatgttattaagaagtggaatagtggatcatcataaaggtcttcatcctcattgtcttcatattgaataagctgaagagaaggagggagaggagggtctcactgtctcaggagtagagagacagaaaaaaatccatgtctaagtgcacccatgcagtttgaacctgtgtcattcaagggttatccataattgacaatatttttaatgatgtcatctattccttctttgtctcccacttacaatcaaatacacatatcattggttgatctgagaagtttagctgatgtgtgacatatttggaacttagcagaagcaaatgagttctgctcttattaccacctcttaatctcaaactatgttagagatgaatatactccactgttactytgagagcaggaggcagccgtctaatacctgcacccctgtcccagggaaacatatatcccagtataggaccaaataggcagatgttgagcaaattgaagtcagcagagtattctcttgacaatgtacatgaaatctcatgcatatgcacctagaaactcaccactaaagctagtggaaancaaaaaaaaaaaaaaaaaaaaaaannaaaagcaggggttgaaatcctagtctctgataaaacagactttaaaccagcaaagatcagggaagacaaagaagggtatattacataatggtaaagggatcaatgcaacaacatgagctaactttcctaaatatatatgcacccaatacaggaacacccagattcacaaagttcttagagacctacaaagagacttagactccaacaaaataatagtgggagactttaacaccccactgtcaatattagacagatcaatgagacagaaaattaacaaggttatttgggacttgaa

SEQ ID NO: 219 - DNA, 716 bp, Homo Sapiens
  allele 501: 12-770-73 : polymorphic base G or A
  misc_binding 481..500: 12-770-73.mis1, potential
  misc_binding 502..521: 12-770-73.mis2, potential complement
  primer_bind 555..573: upstream amplification primer, complement
  primer_bind 115..135: downstream amplification primer
  misc_binding 489..513: 12-770-73 potential probe
aaacctaaacataaccacttcagcctttaactttctcatctgacttgaggcctgtcaggccagcaagaaaaaacaatctaaagcttcagatatctgctgggagcggaaaagcttccctgcttgtattgctttttccctggcaacaagcttccttcttgtcctcctatgctgggcgatgtcattgccatccaccttttagcagcacaggccatttcactgggttacggagccctaactggttaggcctacagttgttaattttcctttaggtatagtgttcttttaagcagtatcatctgacttttcatttagtaatgattagtaactattaagcttagttcatatgatgggatggttttatttttgccatggccaacagttctggagtcacagagagctttctgtacattgacttggagaatgcttgggtgcttatcacccctcctctcattcccccacgtcccccaatccccaaacacacacctttccttcctttctggrttggtggggtgtgtccaggaggcagccaggaaattggtgattacagctttaacccaaagactaattctgacccaggaggctttgacatatgattctttgcattgttcgtgaataaattaataaccagcagtcaacaaaatgttgacctcagaggggcaaatgccttaatacagagcaaatgattcttcatattgagaattctggagttgggagga

SEQ ID NO: 220 - DNA, 1001 bp, Homo Sapiens
  allele 501: 12-772-200 : polymorphic base G or A
  misc_binding 481..500: 12-772-200.mis1, potential
  misc_binding 502..521: 12-772-200.mis2, potential complement
  primer_bind 681..700: upstream amplification primer, complement
  primer_bind 236..256: downstream amplification primer
  misc_binding 489..513: 12-772-200 potential probe
agaatgcctcaaatcccttctgtactaagttcatgtatatataaataagtaaagcattggcagctaattaaaaaaaagtttaatggaaaaattttctttaatttttaatggacttcagtgaaaattgttttcatgggtaaaatgtataagtttgtgtgattgctttgtgagaggtctgtggcacacagaactactgattaatttttcttgttatatacttccctatgtaaatgcacacataacctaaagagtcctggtgacctacattgcctctgcatagattgagttaagcactcttagggcttctgtatgtttggggacttggaggaatctgtggaaagaccttcaaagactagaaggtgtcagaggccaagttctcagcttcaagcctgcatgttattataacccttgcagtgtgtggtcactgggtagggagatgggatgattgagggaggataacagtaggataaagagaccatgagaattcctgggaaggaagcrtatttcctctgtctcctgacatcatgctctcagcaacagtgatttggaggccaaccagtcttgctagaagcctgaataacacttgggtcatccttctgctgagcctagtatataaagagaacaatactattaatggaaatcattcatctatgggtttgtgctccacatctgtctacttgcttgttgactatcttacccccttaggctataagtactcactgatctgtctcgagtgtctggttcatagttaaaagtcaatacttacgtgatgaatgaatgaatagatggaaaaatcaatggatgggtggatggatgatctttacagattaacttgaaccagatcatgtaaggagctgtttaagtagggtactcacattggaggtgattttttcttcctgttaggtcctggacagcatttacttcagccggcggttccatgtgcgttgtgtggccaaggctgtggacaaggtgggccatgtggggacccccttaaggagcaa

SEQ ID NO: 221 - DNA, 1001 bp, Homo Sapiens
  allele 501: 12-772-254 : polymorphic base T or C
  misc_binding 481..500: 12-772-254.mis1, potential
  misc_binding 502..521: 12-772-254.mis2, potential complement
  primer_bind 735..754: upstream amplification primer, complement
  primer_bind 290..310: downstream amplification primer
  misc_binding 489..513: 12-772-254 potential probe
atcttgatttcttcagttatttatttaatgccattctattatatgcattcttgtagaatgcctcaaatcccttctgtactaagttcatgtatatataaataagtaaagcattggcagctaattaaaaaaaagtttaatggaaaaattttctttaatttttaatggacttcagtgaaaattgttttcatgggtaaaatgtataagtttgtgtgattgctttgtgagaggtctgtggcacacagaactactgattaatttttcttgttatatacttccctatgtaaatgcacacataacctaaagagtcctggtgacctacattgcctctgcatagattgagttaagcactcttagggcttctgtatgtttggggacttggaggaatctgtggaaagaccttcaaagactagaaggtgtcagaggccaagttctcagcttcaagcctgcatgttattataacccttgcagtgtgtggtcactgggtagggagatgggatgatygagggaggataacagtaggataaagagaccatgagaattcctgggaaggaagcgtatttcctctgtctcctgacatcatgctctcagcaacagtgatttggaggccaaccagtcttgctagaagcctgaataacacttgggtcatccttctgctgagcctagtatataaagagaacaatactattaatggaaatcattcatctatgggtttgtgctccacatctgtctacttgcttgttgactatcttacccccttaggctataagtactcactgatctgtctcgagtgtctggttcatagttaaaagtcaatacttacgtgatgaatgaatgaatagatggaaaaatcaatggatgggtggatggatgatctttacagattaacttgaaccagatcatgtaaggagctgtttaagtagggtactcacattggaggtgattttttcttcctgttaggtcctggacagcatttacttcagccggcggttccatgtgcgttg

SEQ ID NO: 222 - DNA, 362 bp, Homo Sapiens
  allele 72: 10-87-73 : polymorphic base C or T
  misc_binding 52..71: 10-87-73.mis1, potential
  misc_binding 73..92: 10-87-73.mis2, potential complement
  primer_bind 1..18: upstream amplification primer
  primer_bind 345..362: downstream amplification primer, complement
  misc_binding 60..84: 10-87-73 potential probe
  misc_feature 172..174: n=a, g, c or t
tactcgtagtcaggcggcggcgcaggcggcggcggcggcatasscacagcgcgccttagcagcagcagcagywgcagcagcatcggagtacccccgccgtcgcagcccccgcgctggtgcagccaccctcgctccctctgctcttcctcccttcgctcgcaccatggtagbnnnggtttggcaaatkccggcgtagcagctgccbgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcattta

SEQ ID NO: 223 - DNA, 362 bp, Homo Sapiens
  allele 73: 10-87-74 : polymorphic base A or T
  misc_binding 53..72: 10-87-74.mis1, potential
  misc_binding 74..93: 10-87-74.mis2, potential complement
  primer_bind 1..18: upstream amplification primer
  primer_bind 345..362: downstream amplification primer, complement
  misc_binding 61..85: 10-87-74 potential probe
  misc_feature 172..174: n=a, g, c or t
tactcgtagtcaggcggcggcgcaggcggcggcggcggcatasscacagcgcgccttagcagcagcagcagcwgcagcagcatcggagtacccccgccgtcgcagcccccgcgctggtgcagccaccctcgctccctctgctcttcctcccttcgctcgcaccatggtagbnnnggtttggcaaatkccggcgtagcagctgccbgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcattta

SEQ ID NO: 224 - DNA, 362 bp, Homo Sapiens
  allele 79: 10-87-80 : polymorphic base A or G
  misc_binding 59..78: 10-87-80.mis1, potential
  misc_binding 80..99: 10-87-80.mis2, potential complement
  primer_bind 1..18: upstream amplification primer
  primer_bind 345..362: downstream amplification primer, complement
  misc_binding 67..91: 10-87-80 potential probe
  misc_feature 172..174: n=a, g, c or t
tactcgtagtcaggcggcggcgcaggcggcggcggcggcatasscacagcgcgccttagcagcagcagcagcwgcagcrgcatcggagtacccccgccgtcgcagcccccgcgctggtgcagccaccctcgctccctctgctcttcctcccttcgctcgcaccatggtagbnnnggtttggcaaatkccggcgtagcagctgccbgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcattta

SEQ ID NO: 225 - DNA, 362 bp, Homo Sapiens
  allele 138: 10-87-140 : polymorphic base C or T
  misc_binding 118..137: 10-87-140.mis1, potential
  misc_binding 139..158: 10-87-140.mis2, potential complement
  primer_bind 1..18: upstream amplification primer
  primer_bind 345..362: downstream amplification primer, complement
  misc_binding 126..150: 10-87-140 potential probe
  misc_feature 172..174: n=a, g, c or t
tactcgtagtcaggcggcggcgcaggcggcggcggcggcatasscacagcgcgccttagcagcagcagcagcwgcagcagcatcggagtacccccgccgtcgcagcccccgcgctggtgcagccaccctcgctccctytgctcttcctcccttcgctcgcaccatggtagbnnnggtttggcaaatkccggcgtagcagctgccbgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcattta

SEQ ID NO: 226 - DNA, 368 bp, Homo Sapiens
  allele 81: 10-88-81 : polymorphic base C or T
  misc_binding 62..80: 10-88-81.mis1
  misc_binding 82..101: 10-88-81.mis2, potential complement
  primer_bind 1..18: upstream amplification primer
  primer_bind 349..368: downstream amplification primer, complement
  misc_binding 69..93: 10-88-81 potential probe
taaatgaccgtgctacaggtttcaaaggattttaagattgatttttgaaagatcacaatattaaaagtataactggaaaayctatgttgaaatcaaccaaacatgtcgtggactgaatgataaccttttctttcttcatataggctgatcagctgaccgaagaacagattgctggtaagttgacaactccaaggagtccccagaaggccagaactaggcactgactcagttttggtgactcctctgttcctccccgctacagtctgggcagttttctaagaatttatttaaataagaacagtaagcagaaacactgaggtcagatgttattcttgccagtactttatagatgaggtgaaaggaagtra

SEQ ID NO: 227 - DNA, 420 bp, Homo Sapiens
  allele 41: 10-89-41 : polymorphic base A or G
  misc_binding 21..40: 10-89-41.mis1, potential
  misc_binding 42..61: 10-89-41.mis2, potential complement
  primer_bind 1..19: upstream amplification primer
  primer_bind 401..420: downstream amplification primer, complement
  misc_binding 29..53: 10-89-41 potential probe
aatggctggctttdgcaagcccccggcaagtgtgtattgtractgggttggataaagacattgattctaacgggtcaacttttgttttcagaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaagagctttaaaaccatgaatgagggccattgttgtgtaattcaagttcagacatgttacaggattgtctttcaggtccccagagcaaagcaaatgtgcaaagatcctttctgtggttgccccagggccattgacaattaaaatagaagatgatgggccttgcgtccatcctgcttagtgtct

SEQ ID NO: 228 - DNA, 427 bp, Homo Sapiens
  allele 35: 10-90-35 : polymorphic base A or G
  misc_binding 15..34: 10-90-35.mis1, potential
  misc_binding 36..54: 10-90-35.mis2, complement
  primer_bind 1..18: upstream amplification primer
  primer_bind 409..427: downstream amplification primer, complement
  misc_binding 23..47: 10-90-35 potential probe
atagtctgcccctttgtcctagtacatgtttaccrttccgtacagtggttctgaaatgattactgcagagcagcgttaatggagtgcttactttacatgagctttttgttttttaattcgaggtaatggcaccattgacttccccgaatttttgactatgatggctagaaaaatgaaagatacagatagtgaagaagaaatccgtgaggcattccgagtctttgacaaggtaatccagcatctacatagcagatggtacttaagtatggcttcttccgctttcacttctaaaagctataataatgttatagacagaagacttaaatctaactgcctgagcctctgatctcactttcaaaaatcctccttatggtaaccgtatcaggggagggtaggcataataaataggaattttggaccatgtttc

SEQ ID NO: 229 - DNA, 420 bp, Homo Sapiens
  allele 274: 10-91-274 : polymorphic base G or T
  misc_binding 254..273: 10-91-274.mis1, potential
  misc_binding 275..294: 10-91-274.mis2, potential complement
  primer_bind 1..18: upstream amplification primer
  primer_bind 402..420: downstream amplification primer, complement
  misc_binding 262..286: 10-91-274 potential probe
agcagtmacttgagagggcatagctaagtcaaagacctacttccccacactacatcattagcaataacaattgctgaatgttcacaggatggcaatggttatatcagtgcagcagaactacgtcacgtcatgacaaacttaggagaaaaactaacagatgaagaagtagatgaaatgatcagagaagcagatattgatggagacggacaagtcaactatgaaggtaaaactaaattctctgagctcagtgtttcatagtcttacctttagatckgtaagcaagccaactgcttcactagacagcctttgactttattttatgtacagtaaagatgttgtgttcattaaagctgttttcaaagataaccaaaagttactattatatttgtcttttcagaattcgtacagatgatgactgca

SEQ ID NO: 230 - DNA, 426 bp, Homo Sapiens
  allele 133: 10-93-133 : polymorphic base C or T
  misc_binding 113..132: 10-93-133.mis1, potential
  misc_binding 134..153: 10-93-133.mis2, potential complement
  primer_bind 1..19: upstream amplification primer
  primer_bind 407..426: downstream amplification primer, complement
  misc_binding 121..145: 10-93-133 potential probe
atacactgtttgggctggccagtttttcatgcatgcagcttgacgattgagcacagtcaggcctttgtattaaaaatgaaaaatgaaaaaacaaattcaaaacctattcaaatgggttctagttcaatttgtytagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatct

SEQ ID NO: 231 - DNA, 420 bp, Homo Sapiens
  allele 197: 10-94-197 : polymorphic base A or G
  misc_binding 178..196: 10-94-197.mis1
  misc_binding 198..217: 10-94-197.mis2, potential complement
  primer_bind 1..19: upstream amplification primer
  primer_bind 403..420: downstream amplification primer, complement
  misc_binding 185..209: 10-94-197 potential probe
  misc_feature 351: n=a, g, c or t
aggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctartcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaangccccagcaccaacctctgagcccaagaccttgcctgaaaacaagcagataccgattgcttcatcctat

SEQ ID NO: 232 - DNA, 420 bp, Homo Sapiens
  allele 198: 10-94-198 : polymorphic base G or T
  misc_binding 178..197: 10-94-198.mis1, potential
  misc_binding 199..218: 10-94-198.mis2, potential complement
  primer_bind 1..19: upstream amplification primer
  primer_bind 403..420: downstream amplification primer, complement
  misc_binding 186..210: 10-94-198 potential probe
  misc_feature 351: n=a, g, c or t
aggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagkcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaangccccagcaccaacctctgagcccaagaccttgcctgaaaacaagcagataccgattgcttcatcctat

SEQ ID NO: 233 - DNA, 380 bp, Homo Sapiens
  allele 362: 10-166-362 : polymorphic base A or C
  misc_binding 342..361: 10-166-362.mis1, potential
  misc_binding 363..382: 10-166-362.mis2, potential complement
  primer_bind 1..18: upstream amplification primer
  primer_bind 363..380: downstream amplification primer, complement
  misc_binding 350..374: 10-166-362 potential probe
aactacctcgtcctctgcagacccctctcctcggcagctgaaggagtgtggccaatctgcctccacctccccgcggaccccctactctcaggacctcctgcagcaccccaaactggaagtggccgctgcagacccaaggacgagvggcacgcgggagccggcagccctagtggagcggttggagatgttgaggtgggagggtcacccaggtggggtgaggctggggtaggtagcggagtgaacggcttccgaagctctgggccgcccccaggttggactaagcaggcgctctgtcttcgcccccgcccagggtgggcgtctcctgaggactccccgccacacctgacccgagaccgcgcgcmcagcctagaacgcttccc

SEQ ID NO: 234 - DNA, 464 bp, Homo Sapiens
  allele 387: 10-207-386 : polymorphic base G or C
  misc_binding 368..386: 10-207-386.mis1
  misc_binding 388..407: 10-207-386.mis2, potential complement
  primer_bind 1..12: upstream amplification primer
  primer_bind 444..464: downstream amplification primer, complement
  misc_binding 375..399: 10-207-386 potential probe
  misc_feature 15,409: n=a, g, c or t
gtaggacatttttbnttggctcttaatgacatttgtaggtcaactgtgtagatttgtatgcatttctaaagtatgtttttcccccaatgtgaaatttagtagtaaacttaataaatttccattccaactctcaagtctgtaatttgactcagaaactatactaaattttttgctaggatggcaatggctatattagtgctgcagaacttcgccatgtgatgacaaaccttggagagaagttaacagatgaagaagttgatgaaatgatcagggaagcagatattgatggtgatggtcaagtaaactatgaaggtaaatgtttcagtctcacgcctcattcttcactttgatttttaagataagaggctctttgttagggaactgatsgaaattagtgacccttcccccnaaattaggttgctaaaacagttacttacatttaaccttcttaaaattcagagtgt

SEQ ID NO: 235 - DNA, 464 bp, Homo Sapiens
  allele 409: 10-207-409 : polymorphic base G or C
  misc_binding 390..408: 10-207-409.mis1
  misc_binding 410..429: 10-207-409.mis2, potential complement
  primer_bind 1..12: upstream amplification primer
  primer_bind 444..464: downstream amplification primer, complement
  misc_binding 397..421: 10-207-409 potential probe
  misc_feature 15,409: n=a, g, c or t
gtaggacatttttbnttggctcttaatgacatttgtaggtcaactgtgtagatttgtatgcatttctaaagtatgtttttcccccaatgtgaaatttagtagtaaacttaataaatttccattccaactctcaagtctgtaatttgactcagaaactatactaaattttttgctaggatggcaatggctatattagtgctgcagaacttcgccatgtgatgacaaaccttggagagaagttaacagatgaagaagttgatgaaatgatcagggaagcagatattgatggtgatggtcaagtaaactatgaaggtaaatgtttcagtctcacgcctcattcttcactttgatttttaagataagaggctctttgttagggaactgatcgaaattagtgacccttcccccnaaattaggttgctaaaacagttacttacatttaaccttcttaaaattcagagtgt

SEQ ID NO: 236 - DNA, 361 bp, Homo Sapiens
  allele 307: 10-118-307 : polymorphic base A or G
  misc_binding 287..306: 10-118-307.mis1, potential
  misc_binding 308..326: 10-118-307.mis2, complement
  primer_bind 1..18: upstream amplification primer
  primer_bind 343..361: downstream amplification primer, complement
  misc_binding 295..319: 10-118-307 potential probe
gcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttrtttagccacttaaaatctgcttatggcacaatttgcctcaaaatccattccaag

SEQ ID NO: 237 - DNA, 435 bp, Homo Sapiens
  allele 247: 10-173-247 : polymorphic base A or G
  misc_binding 227..246: 10-173-247.mis1, potential
  misc_binding 248..267: 10-173-247.mis2, potential complement
  primer_bind 1..19: upstream amplification primer
  primer_bind 418..435: downstream amplification primer, complement
  misc_binding 235..259: 10-173-247 potential probe
  misc_feature 427: n=a, g, c or t
cgaagaggaagtataaacgaaataccctttgagattagcctgtcagctgaacagctacatttgcccgtgtccagatttacatgggttttgtgagggcgtgaaatgaagaacgtgcggcttccatgaggccaaaacactaggttaaaaagctgagttcagggtacgcgtttatcggaatctttcagcttcattctttatcggcttaaggtgttttcgtctacccctcaataaggggcgggaaagtggrtgagtgtggcagggaaggatacgtggaagaggaaggttctccagccaagcgcaaagcaggcgactctgccgcctggcgcagttgccaggacagcgcggcccgagcagcaacggcagaagccgcaccgcgtcccggcggcggctgcgagtcccagtgacgcattgcaggtacaaaccagcnaatcagag

SEQ ID NO: 238 - DNA, 435 bp, Homo Sapiens
  allele 294: 10-173-294 : polymorphic base A or G
  misc_binding 274..293: 10-173-294.mis1, potential
  misc_binding 295..313: 10-173-294.mis2, complement
  primer_bind 1..19: upstream amplification primer
  primer_bind 418..435: downstream amplification primer, complement
  misc_binding 282..306: 10-173-294 potential probe
  misc_feature 427: n=a, g, c or t
cgaagaggaagtataaacgaaataccctttgagattagcctgtcagctgaacagctacatttgcccgtgtccagatttacatgggttttgtgagggcgtgaaatgaagaacgtgcggcttccatgaggccaaaacactaggttaaaaagctgagttcagggtacgcgtttatcggaatctttcagcttcattctttatcggcttaaggtgttttcgtctacccctcaataaggggcgggaaagtgggtgagtgtggcagggaaggatacgtggaagaggaaggttctccagccragcgcaaagcaggcgactctgccgcctggcgcagttgccaggacagcgcggcccgagcagcaacggcagaagccgcaccgcgtcccggcggcggctgcgagtcccagtgacgcattgcaggtacaaaccagcnaatcagag

SEQ ID NO: 239 - DNA, 435 bp, Homo Sapiens
  allele 347: 10-173-347 : polymorphic base C or T
  misc_binding 328..346: 10-173-347.mis1
  misc_binding 348..367: 10-173-347.mis2, potential complement
  primer_bind 1..19: upstream amplification primer
  primer_bind 418..435: downstream amplification primer, complement
  misc_binding 335..359: 10-173-347 potential probe
  misc_feature 427: n=a, g, c or t
cgaagaggaagtataaacgaaataccctttgagattagcctgtcagctgaacagctacatttgcccgtgtccagatttacatgggttttgtgagggcgtgaaatgaagaacgtgcggcttccatgaggccaaaacactaggttaaaaagctgagttcagggtacgcgtttatcggaatctttcagcttcattctttatcggcttaaggtgttttcgtctacccctcaataaggggcgggaaagtgggtgagtgtggcagggaaggatacgtggaagaggaaggttctccagccaagcgcaaagcaggcgactctgccgcctggcgcagttgccaggacagcgcggcycgagcagcaacggcagaagccgcaccgcgtcccggcggcggctgcgagtcccagtgacgcattgcaggtacaaaccagcnaatcagag

SEQ ID NO: 240 - DNA, 439 bp, Homo Sapiens
  allele 104: 10-103-104 : polymorphic base C or T
  misc_binding 84..103: 10-103-104.mis1, potential
  misc_binding 105..124: 10-103-104.mis2, potential complement
  primer_bind 1..19: upstream amplification primer
  primer_bind 420..439: downstream amplification primer, complement
  misc_binding 92..116: 10-103-104 potential probe
  misc_feature 176: n=a, g, c or t
tttaggtgggactgatgcccttggccttcctccagggaaggcatccagcatccagaggtaaggattctcctgtggaccttgtgacctctgactcctcccccttyttcccccagagttcaaggaggccttctccctctttgacaaggatggagatggcactatcaccaccaaggagntggggacagtgatgagatccctgggacagaaccccactgaagcagagctgcaggatatgatcaatgaggtggatgcagatggtgagccccacagagcgcgtgggcagccctgctcctggtcaccccgagtgactgcagggagcctccctcagggtgatggatgagcccgtgtctctcagggcccaggccaagagcattctccatcctttccccaccttccagggaacgggaccattgacttcccggagttcctgaccatgatg

SEQ ID NO: 241 - DNA, 439 bp, Homo Sapiens
  allele 323: 10-103-323 : polymorphic base C or T
  misc_binding 304..322: 10-103-323.mis1
  misc_binding 324..343: 10-103-323.mis2, potential complement
  primer_bind 1..19: upstream amplification primer
  primer_bind 420..439: downstream amplification primer, complement
  misc_binding 311..335: 10-103-323 potential probe
  misc_feature 176: n=a, g, c or t
tttaggtgggactgatgcccttggccttcctccagggaaggcatccagcatccagaggtaaggattctcctgtggaccttgtgacctctgactcctcccccttcttcccccagagttcaaggaggccttctccctctttgacaaggatggagatggcactatcaccaccaaggagntggggacagtgatgagatccctgggacagaaccccactgaagcagagctgcaggatatgatcaatgaggtggatgcagatggtgagccccacagagcgcgtgggcagccctgctcctggtcaccccgagtgactgcagggagcctcyctcagggtgatggatgagcccgtgtctctcagggcccaggccaagagcattctccatcctttccccaccttccagggaacgggaccattgacttcccggagttcctgaccatgatg

SEQ ID NO: 242 - DNA, 439 bp, Homo Sapiens
  allele 403: 10-103-402 : polymorphic base C or T
  misc_binding 383..402: 10-103-402.mis1, potential
  misc_binding 404..423: 10-103-402.mis2, potential complement
  primer_bind 1..19: upstream amplification primer
  primer_bind 420..439: downstream amplification primer, complement
  misc_binding 391..415: 10-103-402 potential probe
  misc_feature 176: n=a, g, c or t
tttaggtgggactgatgcccttggccttcctccagggaaggcatccagcatccagaggtaaggattctcctgtggaccttgtgacctctgactcctcccccttcttcccccagagttcaaggaggccttctccctctttgacaaggatggagatggcactatcaccaccaaggagntggggacagtgatgagatccctgggacagaaccccactgaagcagagctgcaggatatgatcaatgaggtggatgcagatggtgagccccacagagcgcgtgggcagccctgctcctggtcaccccgagtgactgcagggagcctccctcagggtgatggatgagcccgtgtctctcagggcccaggccaagagcattctccatcctttccccaccttccagggaaygggaccattgacttcccggagttcctgaccatgatg

SEQ ID NO: 243 - DNA, 424 bp, Homo Sapiens
  allele 98: 10-106-98 : polymorphic base A or C
  misc_binding 78..97: 10-106-98.mis1, potential
  misc_binding 99..118: 10-106-98.mis2, potential complement
  primer_bind 1..19: upstream amplification primer
  primer_bind 406..424: downstream amplification primer, complement
  misc_binding 86..110: 10-106-98 potential probe
tctctctgcttcactccacagagtttgtacagatgatgactgcaaagtgaaggccccccgggcagctggcgatgcccgttctcttgatctctctcttmtcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccaygtcttccaaggcctgatgcattcataagttgaagccctccccagatccccttggggagcctctgccctcctccagcccggatggctctcctccattttggtttgtttcctcttgtttgtcatcttattttgggtgc

SEQ ID NO: 244 - DNA, 424 bp, Homo Sapiens
  allele 288: 10-106-288 : polymorphic base C or T
  misc_binding 269..287: 10-106-288.mis1
  misc_binding 289..308: 10-106-288.mis2, potential complement
  primer_bind 1..19: upstream amplification primer
  primer_bind 406..424: downstream amplification primer, complement
  misc_binding 276..300: 10-106-288 potential probe
tctctctgcttcactccacagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccaygtcttccaaggcctgatgcattcataagttgaagccctccccagatccccttggggagcctctgccctcctccagcccggatggctctcctccattttggtttgtttcctcttgtttgtcatcttattttgggtgc

SEQ ID NO: 245 - DNA, 424 bp, Homo Sapiens
  allele 380: 10-106-378 : polymorphic base C or T
  misc_binding 361..379: 10-106-378.mis1
  misc_binding 381..400: 10-106-378.mis2, potential complement
  primer_bind 1..19: upstream amplification primer
  primer_bind 406..424: downstream amplification primer, complement
  misc_binding 368..392: 10-106-378 potential probe
tctctctgcttcactccacagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccaygtcttccaaggcctgatgcattcataagttgaagccctccccagatccccttggggagcctctgccctcctccagcccggatggctctcctycattttggtttgtttcctcttgtttgtcatcttattttgggtgc

SEQ ID NO: 246 - DNA, 371 bp, Homo Sapiens
  allele 160: 10-168-160 : polymorphic base C or T
  misc_binding 141..159: 10-168-160.mis1
  misc_binding 161..180: 10-168-160.mis2, potential complement
  primer_bind 1..18: upstream amplification primer
  primer_bind 354..371: downstream amplification primer, complement
  misc_binding 148..172: 10-168-160 potential probe
  misc_feature 206: n=a, g, c or t
gttcctcaagatagggggcagagtgggaaaatgaccatagtcagaatctatgggaaggacccacccaaaaggaaaaggcttcttgtgcccaggctgcagatccaaaccccagggaaggactctcattggttcagtctccattctgttccaggtggagcayaatgattggtccagcctgactcgtttgcccatctcttaaccatcancatggtggggaggggacacgcaggagactgtcagctcctatcctaaacgggggagggggcaggggtgatcattttctgagctcctataaacaaagtttcagttctttttcctcctatggctggaacactggaataaggaaagaggtcgtctgtctggagaggctg

SEQ ID NO: 247 - DNA, 371 bp, Homo Sapiens; identical to SEQ ID NO: 246
  allele 206: 10-168-206 : polymorphic base A or C
  misc_binding 187..205: 10-168-206.mis1
  misc_binding 207..226: 10-168-206.mis2, potential complement
  primer_bind 1..18: upstream amplification primer
  primer_bind 354..371: downstream amplification primer, complement
  misc_binding 194..218: 10-168-206 potential probe
  misc_feature 206: n=a, g, c or t

SEQ ID NO: 248 - DNA, 371 bp, Homo Sapiens
  allele 283: 10-168-284 : polymorphic base A or T
  misc_binding 263..282: 10-168-284.mis1, potential
  misc_binding 284..303: 10-168-284.mis2, potential complement
  primer_bind 1..18: upstream amplification primer
  primer_bind 354..371: downstream amplification primer, complement
  misc_binding 271..295: 10-168-284 potential probe
  misc_feature 206: n=a, g, c or t
gttcctcaagatagggggcagagtgggaaaatgaccatagtcagaatctatgggaaggacccacccaaaaggaaaaggcttcttgtgcccaggctgcagatccaaaccccagggaaggactctcattggttcagtctccattctgttccaggtggagcayaatgattggtccagcctgactcgtttgcccatctcttaaccatcancatggtggggaggggacacgcaggagactgtcagctcctatcctaaacgggggagggggcaggggtgatcattttcwgagctcctataaacaaagtttcagttctttttcctcctatggctggaacactggaataaggaaagaggtcgtctgtctggagaggctg

SEQ ID NO: 249 - DNA, 425 bp, Homo Sapiens
  allele 317: 10-169-318 : polymorphic base A or C
  misc_binding 297..316: 10-169-318.mis1, potential
  misc_binding 318..337: 10-169-318.mis2, potential complement
  primer_bind 1..20: upstream amplification primer
  primer_bind 408..425: downstream amplification primer, complement
  misc_binding 305..329: 10-169-318 potential probe
tgattggtccagcctgactcgtttgcccatctcttaaccatcaccatggtggggaggggacacgcaggagactgtcagctcctatcctaaacgggggagggggcaggggtgatcattttctgagctcctataaacaaagtttcagttctttttcctcctatggctggaacactggaataaggaaagaggtcgtctgtctggagaggctggttggggagtatggtctccccagcccagccaagctcaggtccctgcatacagcaggcgcctaattgatgcttatagcacgaatgactgaatgaataccccgttcccamaggctgtcctgggatggtcctaatttcacagaccctgagcggatcaagaatgaagcgggcccaggggtcccgcccaccggctgagtgcgtcttaggacgcagagacaa

SEQ ID NO: 250 - DNA, 1001 bp, Homo Sapiens
  allele 501: 12-86-79 : polymorphic base G or A
  misc_binding 502..520: 12-86-79.mis1, complement
  misc_binding 481..500: 12-86-79.mis2, potential
  primer_bind 562..579: upstream amplification primer, complement
  primer_bind 130..149: downstream amplification primer
  misc_binding 489..513: 12-86-79 potential probe
  misc_feature 944: n=a, g, c or t
ttcctcccctgtaaaattagagagggctggacataattatctgcaaggtcactttcactttctatgatcattcaagacaagcattaagatgcaaggacaaaatgtgctcattgtaagcctgcctgtcctatagacaaaggcattctcagtacactaaacacttgttaagagtgttgttaagagccagagtgagtatcatgtaagacacagaccctttcttcctaaaggctttgtggcatcagacacataaagggtatatgtagtgtggagcactaaccatggcagggtaatttattccaggcacagagtcataattctggaaacatctagactcactgcattaacagagcattttgtttctaaagtagacctcttatgtcatccagatttcactcattctgaccacagccaggaagctgagggtgaagccagaattagctgaaacccaccaagagctgcatagagcacgtttagctagagtaggagtttgcagtgctcatrtgggaaatgctgctgctatacttttaggaatttctgagtgcaatttagaaacatctagcacacttgaaacactgcgtatcattttcctcactcatgaatatagtcatcagaattcataaatagtttacctgagccctttaacaacctcaaataggccatatttctctctctggttgatggcatggaccctacaggaaaaaccacaccttaccgcttctgaccagcatcactacaaaaaggagtgctgaagccaatcaccatgtaagcaagataaaagcaaagggggtcttgcctgcccatctctgttccatacattcttaccaggcactgagagtcatggggagtttaagactccatcccacatactccttttgaaactggtccagtgtacaacatccagtgaagagtataggatggcatagacttaccaactcaaagaatgnaaggattctagaaacattatagtccaacctcctcaattcatcgttgatacacaaagg

SEQ ID NO: 251 - DNA, 1001 bp, Homo Sapiens
  allele 501: 12-88-393 : polymorphic base C or A
  misc_binding 481..500: 12-88-393.mis1, potential
  misc_binding 502..521: 12-88-393.mis2, potential complement
  primer_bind 875..894: upstream amplification primer, complement
  primer_bind 444..464: downstream amplification primer
  misc_binding 489..513: 12-88-393 potential probe
  misc_feature 501,833,976: n=a, g, c or t
tcactttctccgtaatatcagttaccaccattttcaatagcagaaaaatagtccattaaactgatatactatataattagccattaaggtagatatttaaattatttccaatcttttgctgctctaaatgaaaatgtccactggaacattatgaatatagcttttcctctattttggattatttccttagaatccagtcctgattatgtaacttttaaaggacatgaatctagaagtaacccaacaagacaattcatcacagattactatgtattgaccaaaacatgtcaactgagaggcagaatagtatgtataagctttggagttatgaatttgaactcatctcattagccactggtctcatcttaaacaagtaacactaggatccatcagttccactgtccttttatggatacagagctaattaaatacttttaggaattagaatgactcccttaactgtgggttctcctgattttaacttttaaagtctgggattcngttaaatccaagaaactttttttgagtcctactacatgccctggttctatgtgagggacaggtaaaacagagagaagacttagaccctgccttcaagtgttagcagccttggatgtgaaaaatactacaagagaaatagatacaggcatagaacggatgactttcagggaaaactttgaaatgatggagtgatttcctacggataaaaagttcattaaggagagaatggggagggggcctgctccaagcgaaggcataggagattgaaataaacgtatcacattggggaactgctagggtttcagccttcatatatgtaaggtggaaagagnaagagcagcaagatgtgaagaactagagggatcacaccatagggcttagatttcaacttctaggtcagtatttccaaagaccagcatgaaaaatgattttaggtggcacaaggacaaaaatatatgtattttaaaatataacnaaaatatattcatatattataaaag

SEQ ID NO: 252 - DNA, 1001 bp, Homo Sapiens
  allele 501: 12-89-369 : polymorphic base G or C
  misc_binding 482..500: 12-89-369.mis1
  misc_binding 502..521: 12-89-369.mis2, potential complement
  primer_bind 133..151: upstream amplification primer
  primer_bind 564..584: downstream amplification primer, complement
  misc_binding 489..513: 12-89-369 potential probe
  misc_feature 760: n=a, g, c or t
ccctgttacaagtaaggaaaccaaaggacagagagggaaagtaactgcccagtcacacagctagtaaatggcagaggtggggcatagatccaggcagcctgaaggttgtactctgatgataagatgaatttctggcaagcacgttttgctgacctctccaaggcagacctaatgtggtgacaaaacctatcacacttgcttactgtggcacgatgcttttgcgttgtgacacagcatagctacagtgcttacagcacaatgctgtgagcccagaggagcttcatgtcacctttaatgacccaaattagacctaagaaaattgttagccaacaatgacagcatccttacatcacgtcagcgctttaaaaagtggtgaaatttaatactcagtttgcttttgaaatcaggttcacccaacctccactcttagctgtgcattagataaatgtagaaattgcctcctttttcatcttgagtctcaaacaacagctctggactcasagctaatagacttcctgagtccaaccaattcaagcagccaatgaggcatcctggcaaatgaggacatttctccaggggatgaggctgtccttggtgcccttgctcccctctgccagcaggataggttctgtgagttatgcttctggtcacgttggtgggtttgtgctgacctgtccccagtagactcttttgtgatgaggggtgggactaatgagacgcctggccaaagtggcagaatctgtgactgtgaaagatggtnacactgccaggtataaggaaggacttaagttgatgggcaccaaacagagaactttctctatgcctgtgactggaacatgtccatcttggtagccaggtctccactacacaattcagtttttgctcccttagcagttaactgtcaaattagaaatccatcctgttttagtctttaaagccttgatataatttaactatagtcagcagaaacaaacaaatgaacaaaatccatcaataacttg

SEQ ID NO: 253 - DNA, 1000 bp, Homo Sapiens
  allele 501: 12-89-91 : polymorphic base A or G
  misc_binding 481..500: 12-89-91.mis1, potential
  misc_binding 502..521: 12-89-91.mis2, potential complement
  primer_bind 411..429: upstream amplification primer
  primer_bind 842..862: downstream amplification primer, complement
  misc_binding 489..513: 12-89-91 potential probe
ctgtacatgagcaaaatagagaagaattagataaacatggctttgtatatagcagtgtcccagtaagtaagcaaactgatattccctacataccctatttcagagggcaggctgaggggcgctcaggcagaaatacagtaagttcaactgaatggcaagttctttaatccaagattgaagtgtgtggcaaaacatgccaggaactcttacaagcagttggcatgaattaacttctttgatcctcacagcagccctaaaagtaggaaatatttttctgtccctgttacaagtaaggaaaccaaaggacagagagggaaagtaactgcccagtcacacagctagtaaatggcagaggtggggcatagatccaggcagcctgaaggttgtactctgatgataagatgaatttctggcaagcacgttttgctgacctctccaaggcagacctaatgtggtgacaaaacctatcacacttgcttactgtggcacgatgcttttgcrttgtgacacagcatagctacagtgcttacagcacaatgctgtgagcccagaggagcttcatgtcacctttaatgacccaaattagacctaagaaaattgttagccaacaatgacagcatccttacatcacgtcagcgctttaaaaagtggtgaaatttaatactcagtttgcttttgaaatcaggttcacccaacctccactcttagctgtgcattagataaatgtagaaattgcctcctttttcatcttgagtctcaaacaacagctctggactcacagctaatagacttcctgagtccaaccaattcaagcagccaatgaggcatcctggcaaatgaggacatttctccaggggatgaggctgtccttggtgcccttgctcccctctgccagcaggataggttctgtgagttatgcttctggtcacgttggtgggtttgtgctgacctgtccccagtagactcttttgtgatgaggggtgggactaatgagacgcct

SEQ ID NO: 254 - DNA, 1001 bp, Homo Sapiens
  allele 501: 12-94-210 : polymorphic base C or T
  misc_binding 481..500: 12-94-210.mis1, potential
  misc_binding 502..521: 12-94-210.mis2, potential complement
  primer_bind 292..312: upstream amplification primer
  primer_bind 819..839: downstream amplification primer, complement
  misc_binding 489..513: 12-94-210 potential probe
  misc_feature 745: n=a, g, c or t
gactgtggaggattcaccaccagactgggaaacaacagcctgggctccagagttggacactcaccaccagactgggaagtaacagcctgggctccagagtccaccactcatccgtgcacagatgaggagcggcctcatgaagcttcggtgcggtctgggaccctatctctttttgtaacgagttgtttggcatgaggtccagtcaggagggcccttcgcaactgggctcaaggaacacaaaaaggtcaacctgtttttgtgattgtctgttgtttttcaataactaatgtacaggaatagattgaaatagagatttttctgaaacagcgctggatgaatgcctcaaggggctcaaacaacctgttccaggacttggtgactattgtttgtgttcatgtttaattgagttcaaatttaatatttaacttttcctccacaatgggtgagtttgtattactatgttttactgtctcatgaataaaatcctaaaataaaagccayaaaatctttgtgtttaggtgtgcctacacatatgtacatttattattttctgtgttgtatctatatggtaaaacctgatgtagtcagtagaattcccttaagaaattctattcagattggctagataagtgaatgctcatataaattgttaaaatatatagtaactaacccaaatgcattttagttcatgtgacttaaataaatctttgataaatatgctagttttaattctgttgataaaatnaaaaatagaaatgtcttcagaattgtcagcatatatttttgactgagtttaccgattagacagttttatatttgtctctgctaaatgttttaaggggtcaggatttgacacaaagtttataaaactgtatatctagtctaaaaataaaatgatctttgtgtaactttaataagtaagacaaatttaataatgttaatttaataaaacagctattatcagcaaaatttttgttatcttgttctcagcaaaataccca

SEQ ID NO: 255 - DNA, 1001 bp, Homo Sapiens
  allele 521: 12-94-516 : polymorphic base A or T
  misc_binding 501..520: 12-94-516.mis1, potential
  misc_binding 522..541: 12-94-516.mis2, potential complement
  primer_bind 6..26: upstream amplification primer
  primer_bind 533..553: downstream amplification primer, complement
  misc_binding 509..533: 12-94-516 potential probe
  misc_feature 459,789,797,822,828,870: n=a, g, c or t
atgtacaggaatagattgaaatagagatttttctgaaacagcgctggatgaatgcctcaaggggctcaaacaacctgttccaggacttggtgactattgtttgtgttcatgtttaattgagttcaaatttaatatttaacttttcctccacaatgggtgagtttgtattactatgttttactgtctcatgaataaaatcctaaaataaaagccacaaaatctttgtgtttaggtgtgcctacacatatgtacatttattattttctgtgttgtatctatatggtaaaacctgatgtagtcagtagaattcccttaagaaattctattcagattggctagataagtgaatgctcatataaattgttaaaatatatagtaactaacccaaatgcattttagttcatgtgacttaaataaatctttgataaatatgctagttttaattctgttgataaaatnaaaaatagaaatgtcttcagaattgtcagcatatatttttgactgagtttaccgattagacwgttttatatttgtctctgctaaatgttttaaggggtcaggatttgacacaaagtttataaaactgtatatctagtctaaaaataaaatgatctttgtgtaactttaataagtaagacaaatttaataatgttaatttaataaaacagctattatcagcaaaatttttgttatcttgttctcagcaaaatacccatatgtttatctgtaagattcttacttaggtgaatacctgaaattcacatactgtaagaatagttaatgacaacnaacaaaangcttgaaatgatgactagctttgtnctaatnagctcagttttcataagtaatctaggtataattgttaacaantaaattaggtaaacataatgggataaatatttttaaataaatttttcatgtaatttaaaatctgaaagttatgttacattaaattaagtaatacatactcattaaatgtctgggtcatttccagataagat

SEQ ID NO: 256 - DNA, 1001 bp, Homo Sapiens
  allele 501: 12-96-64 : polymorphic base C or A
  misc_binding 502..521: 12-96-64.mis1, potential complement
  misc_binding 482..500: 12-96-64.mis2
  primer_bind 547..564: upstream amplification primer, complement
  primer_bind 101..121: downstream amplification primer
  misc_binding 489..513: 12-96-64 potential probe
  misc_feature 875: n=a, g, c or t
ttttcccttggtttccatacgaactcatctaagtttaattcctatatctctggaaatttgtttcttcatggaatcacctactttcttattaaatttgggaacatttgccctttggactctcttctcacattgtgtggccttctggcaacattagctactctttgcctagattctgatagaaagcttgggtttaaatttgactctgacccttcctggctgagggactggattttccaaataacaaccaattcttcagttctctgacaccaatggggtgttctacatttgaattaaaatctgacactaactacaccgggttagcacagaccccatgttaaccttgtgcttaatcccacaagactgccctcacttcagacaccacaaatgggattcccagactacctacacttttgcctaaccaactattaattctggggttcccatgacctctttcctctttagtaattccctatgtgaccagaaagaaaaaaatagatgccmctttatcaactaatatggacccaaaggttaaggaaacaaaattacctatgggtcaagggttcagggcctggctggcatggcacattttgaaattcctatgactaaactccctaaaaataggagcaatcaggccgggtgcggtgactcatacctgtaaccccagcactctgggaggccgagatgggtggaccacctgaggtcaggagttcaagaccagtctggccaatacggtgaaaccccatctctactaaaaatacaaaaaattagtcaggtgtggtggtggttgcctgtaattccagctacttgggaggctgaggcaggagaatctcttgaacccgggaggcagaggttgcagtgagctgagatcgcgccantgtactccagcctggtcaacaagagcaaaactttgtctcaaaaaaataaaggagcaatcacctctgatttacaaccaagaccactgcaactctgattggacacaggaccagtcttacaaacattct

SEQ ID NO: 257 - DNA, 1001 bp, Homo Sapiens
  allele 501: 12-97-83 : polymorphic base A or C
  misc_binding 481..500: 12-97-83.mis1, potential
  misc_binding 502..521: 12-97-83.mis2, potential complement
  primer_bind 419..437: upstream amplification primer
  primer_bind 866..886: downstream amplification primer, complement
  misc_binding 489..513: 12-97-83 potential probe
gttctcacttgagccttgaccaaaaggggaaaattgttaaataaaaattataggaggccattgttttggactaagctcctgcactaggccccagcagatcagaataaaaatcaaaatggagccagtcatactaaagtttaatgtaaccaaaccaaaactaagttgttatttgatcttcctagaaatcaggagagagagaacagcttaatttcccaaacgggcatgataataaagtttcgtctgccctaatcattaccaaaaaatgtaacctgatgttaacaattagttatttctccattgttctgtttcctcttctcactgtacaaggaaagtaactgtgaaatgagttatccgctctttgttctttgtttctgctttcttcagcccttctgtctgtaaaaccaatctcctctgctcagctcattggaacactattctgttttatagaatgaggttttgttttattctagaattgcaaataaagccaattgaggtcttcamactaaatattttggaattgtatcctttgacacccccattaagcactttctatatctagcctctgcctgtttcaacatactcaaacctctttcacataaaacaacagtcatgacagcagaaactctcacacctatacccttcatccattgctacccctctttccaccaaagacaacgttccaaaaaaaaaaaaaaagaaaagaaaaacccaaaccaacttacatttaaaaaactctttttgttctggccccaggtattattgaattgtcattcacaactgccaagtttagtgaatatttgtcaagccttgtcttacttaatgtcttcacagcaattaagagtataaatcacctttctttaaacttccttttcccttggtttccatacgaactcatctaagtttaattcctatatctctggaaatttgtttcttcatggaatcacctactttcttattaaatttgggaacatttgccctttggactctcttctcacattgtg

SEQ ID NO: 258 - DNA, 1001 bp, Homo Sapiens
  allele 501: 12-99-296 : polymorphic base G or A
  misc_binding 482..500: 12-99-296.mis1
  misc_binding 502..521: 12-99-296.mis2, potential complement
  primer_bind 776..796: upstream amplification primer, complement
  primer_bind 347..366: downstream amplification primer
  misc_binding 489..513: 12-99-296 potential probe
  misc_feature 501,903: n=a, g, c or t
acccaccaagagctgcatagagcacgtttagctagagtaggagtttgcagtgctcatgtgggaaatgctgctgctatacttttaggaatttctgagtgcaatttagaaacatctagcacacttgaaacactgcgtatcattttcctcactcatgaatatagtcatcagaattcataaatagtttacctgagccctttaacaacctcaaataggccatatttctctctctggttgatggcatggaccctacaggaaaaaccacaccttaccgcttctgaccagcatcactacaaaaaggagtgctgaagccaatcaccatgtaagcaagataaaagcaaagggggtcttgcctgcccatctctgttccatacattcttaccaggcactgagagtcatggggagtttaagactccatcccacatactccttttgaaactggtccagtgtacaacatccagtgaagagtataggatggcatagacttaccaactcaaagaatgnaaggattctagaaacattatagtccaacctcctcaattcatcgttgatacacaaaggcccactaagctgtgtggttcactcagcatcacgtggctaatatgatatgaagccacactagcttgtcctcagctgtgccaagaatgagagctgccttctccaaacctaaaaccaacccatggcatcattaacacctctttaaaatccataggacagtgatccaaaacttattccctaaatcataaatatcttttcataaggagtttcctttgtaagggatttgaccatgccattaggaataaaattttaataagagaatgtaagtttaaaccataaaatgaggagcttagggtggttcttaggcagaatctaaatatgaaattactgaaatgctcccacaaggcnaaaaaaaaaaaaaaatacatttagatgaactccaaaggttgcttatgacctaaaacaagagctcaagtaattgggagatatatacacagttctcagca

SEQ ID NO: 259 - DNA, 1001 bp, Homo Sapiens
  allele 501: 12-100-266 : polymorphic base T or C
  misc_binding 502..521: 12-100-266.mis1, potential complement
  misc_binding 482..500: 12-100-266.mis2
  primer_bind 749..768: upstream amplification primer, complement
  primer_bind 253..273: downstream amplification primer
  misc_binding 489..513: 12-100-266 potential probe
  misc_feature 546,592: n=a, g, c or t
caagtgattcttctgactcagcctcctgagtagtggggactacaggcgtgcaccaccacaccgggctaatttttgtaattttagtagagacgggggcttcatgatattgtccaggctggtctcaaactcctgacctcgtgatctgcctgcctcagcctcccaaagtgctgggattataggcgtgagccaccacgcctggctgagcacattttttaaactgatggaaaattacatcaagaaaaattcagagctcaagggacattatttgaactctgtaagcttagtttttaaactgccagcaactatagagctaacatgtagggcctttaaattctctatttttttctgcctactttgaatctgctgacttttctaccggtattaagacaaattctctgcttttgacattccagccaacataaaaaaagaaatcttaaaagacttttaaattaatgactttacaaattacaatagctctgtggaaataaataacctagacayctaagagtcaaaccttttgaaaatgtaaatttggctaataatagncttagagtgatgaaacagttaattgaaggattgctattctgaaagnaaataaactaaataaatttataaaagttaggctcataggtcgaacaggtaaaaatcttgagcaataatataaggtaactctgtctggcataaaaaaaaattaatctgccatgcaagggtcagaaatagctaggaaaaaacctacaaataactttttctaaaatgctttcacaactgcattgactagtcaagcaaaccagactgacaaacaaaagatagattgttactaattcaaggctgcttggaaattttggtttcttatactcttcagccagttctagctaaaatgtaaacatttaaaaatttaaccccctaaactcatttgagacaaaaaagggggtaaaagagatttaaaaaatccaaactacttttcccaatattttggtccacagcctttgttagattaccta

SEQ ID NO: 260 - DNA, 1001 bp, Homo Sapiens
  allele 501: 12-811-174 : polymorphic base T or C
  misc_binding 481..500: 12-811-174.mis1, potential
  misc_binding 502..521: 12-811-174.mis2, potential complement
  primer_bind 656..675: upstream amplification primer, complement
  primer_bind 127..146: downstream amplification primer
  misc_binding 489..513: 12-811-174 potential probe
  misc_feature 528: n=a, g, c or t
gcaagtgacacatatcacttccagtcccattgtgttggtggctagtcacatagtcctacctaggggtatgaggtggtagaaatataatccctagctgagcggccaaaactctacacaatgaaaagaggaacacacatttctggtagatagcccaccttctgtgccacagccacaaacccaaaaaagttgagggtaataggattttgtggctgtgccacatggagaagtggtaaaattcccaatactgcctcactagtggatcaatctctccagctcccaacattttgtacattggaacctacttcagccctggtagaagatttgaacattgctttctcatcatttcagagaccacatggatggggcctctgctctcattcctccagtggccattcagttggctaccctcctgctaagacactatccttgctgggcagctcaggcttaggcactggtccctgatgccatcagttttctctagggaagcagagctggcttcaytgaatgcatgtagttgacaaggtatanactacttcctggagaaagaactgcctgggaccccttttcctagagagactataagcatggctgatacttgaagctttatggacctgctagtacacagagtcattaagaaaccacatgaggccaggaagagcaaggtgtgctgaccattttcatcactgtattcccagtactcagcacaatgttttagaaaccctgcagcatcctcctggagatgcacccactagggccttagagttctgctggcagattggagaagagagaaaaaagaagacacagtacagtacagttgaacagttacttgtcaaataaaaaggtgaaaagaatgatttaaatgaataaacatatgatcttgataaatatttagtaacataggaaagagtaagaacaaaaggaaaaagtatgggacaaaaatagaaacagtcatgtgtcgcttaatgatgaggatacgttctgagaaatgtgcccttacacga

SEQ ID NO: 261 - DNA, 1001 bp, Homo Sapiens
  allele 501: 12-815-94 : polymorphic base A or G
  misc_binding 481..500: 12-815-94.mis1, potential
  misc_binding 502..521: 12-815-94.mis2, potential complement
  primer_bind 408..428: upstream amplification primer
  primer_bind 849..859: downstream amplification primer, complement
  misc_binding 489..513: 12-815-94 potential probe
  misc_feature 501,790..791,798,845,848: n=a, g, c or t
tccccaagcctccttgtcatcagggagggtcaaaattcctgatcatcagataaaaccattagttactgaccatgaattagcacaggcatttacatgaggccatctcttttttcagaaaaagtagatgatgagatgtacagctcaaagtcatgctctgggaaggctttctctttcccatcatccttcagtgccaccatagtggggccaaagagatgctgcctccacttctggttgatgtcagcatatcatgtggaataatctacaaactaggctctaatttttccctccaaagtcaagaaaaaattcagtgattagtaaactaaatttttattattttccttctcaaaaagaggaaataactttccatgaggttgcaggggaggattgaaggacaggtgacactgtggcaggagtaggtgctctaagtgtgagccccttgaaagtacaatttatttgtgctttgtagggcctggcctcatttcttccacttctattttatgntagggcattgctgaacacttctgattttttggctaaggggataaaataacacctaagtttatgattggcagttcagatcacatggtgctctgatattccatggtgagtctgaccaaaccacagaatctaggccagcttcaaggattagtaggaatgatgattaggacttgatcaaggttactttcattttagtttactacagaaccagaagacaagcaaagcacatgatagtcaccagttcgagtatggtggtatgaaatactagatactttctttcccaggctccttnnttcctcnctttttcctttgtgcctgaagttcaatggtctcagaagccaatgcangangtaagacattcagtgagataaaggagcccagaaccacaagctttctgccttttggagcattttaggttgcagagtggtgccatatagcactcaaggatccaatgtactagcatagtagaaatttcttgtatagcgactgtatgatttggctac

SEQ ID NO: 262 - DNA, 1001 bp, Homo Sapiens
  allele 501: 12-815-383 : polymorphic base A or G
  misc_binding 481..500: 12-815-383.mis1, potential
  misc_binding 502..521: 12-815-383.mis2, potential complement
  primer_bind 119..139: upstream amplification primer
  primer_bind 560..570: downstream amplification primer, complement
  misc_binding 489..513: 12-815-383 potential probe
  misc_feature 212,501..502,509,556,559: n=a, g, c or t
aagtcaagaaaaaattcagtgattagtaaactaaatttttattattttccttctcaaaaagaggaaataactttccatgaggttgcaggggaggattgaaggacaggtgacactgtggcaggagtaggtgctctaagtgtgagccccttgaaagtacaatttatttgtgctttgtagggcctggcctcatttcttccacttctattttatgntagggcattgctgaacacttctgattttttggctaaggggataaaataacacctaagtttatgattggcagttcagatcacatggtgctctgatattccatggtgagtctgaccaaaccacagaatctaggccagcttcaaggattagtaggaatgatgattaggacttgatcaaggttactttcattttagtttactacagaaccagaagacaagcaaagcacatgatagtcaccagttcgagtatggtggtatgaaatactagatactttctttcccaggctccttnnttcctcnctttttcctttgtgcctgaagttcaatggtctcagaagccaatgcangangtaagacattcagtgagataaaggagcccagaaccacaagctttctgccttttggagcattttaggttgcagagtggtgccatatagcactcaaggatccaatgtactagcatagtagaaatttcttgtatagcgactgtatgatttggctactttcacatcttatgcattactgcataatggggctgaatcaaagaattggtgcagaaagtctgaccatgccttaccacacattgtcaggctatcaataattttttttcaaaaggataataaaaactgcctaaagagaacataggtttgctccaaaaaacctaggggatgcccctatgattctcctattggagcttgccctaggctttacaccgcatcttgatcttccacagtcagtgtgagcaccattagatgcactgggtcatgggggccatgtggcagagttgtttgc

SEQ ID NO: 263 - DNA, 1001 bp, Homo Sapiens
  allele 500: 12-815-384 : polymorphic base G or C
  misc_binding 480..499: 12-815-384.mis1, potential
  misc_binding 501..520: 12-815-384.mis2, potential complement
  primer_bind 118..138: upstream amplification primer
  primer_bind 559..569: downstream amplification primer, complement
  misc_binding 488..512: 12-815-384 potential probe
  misc_feature 211,500..501,508,555,558: n=a, g, c or t
agtcaagaaaaaattcagtgattagtaaactaaatttttattattttccttctcaaaaagaggaaataactttccatgaggttgcaggggaggattgaaggacaggtgacactgtggcaggagtaggtgctctaagtgtgagccccttgaaagtacaatttatttgtgctttgtagggcctggcctcatttcttccacttctattttatgntagggcattgctgaacacttctgattttttggctaaggggataaaataacacctaagtttatgattggcagttcagatcacatggtgctctgatattccatggtgagtctgaccaaaccacagaatctaggccagcttcaaggattagtaggaatgatgattaggacttgatcaaggttactttcattttagtttactacagaaccagaagacaagcaaagcacatgatagtcaccagttcgagtatggtggtatgaaatactagatactttctttcccaggctccttnnttcctcnctttttcctttgtgcctgaagttcaatggtctcagaagccaatgcangangtaagacattcagtgagataaaggagcccagaaccacaagctttctgccttttggagcattttaggttgcagagtggtgccatatagcactcaaggatccaatgtactagcatagtagaaatttcttgtatagcgactgtatgatttggctactttcacatcttatgcattactgcataatggggctgaatcaaagaattggtgcagaaagtctgaccatgccttaccacacattgtcaggctatcaataattttttttcaaaaggataataaaaactgcctaaagagaacataggtttgctccaaaaaacctaggggatgcccctatgattctcctattggagcttgccctaggctttacaccgcatcttgatcttccacagtcagtgtgagcaccattagatgcactgggtcatgggggccatgtggcagagttgtttgca

SEQ ID NO: 264 - DNA, 1001 bp, Homo Sapiens
  allele 501: 12-815-391 : polymorphic base C or T
  misc_binding 481..500: 12-815-391.mis1, potential
  misc_binding 502..521: 12-815-391.mis2, potential complement
  primer_bind 111..131: upstream amplification primer
  primer_bind 552..562: downstream amplification primer, complement
  misc_binding 489..513: 12-815-391 potential probe
  misc_feature 204,493..494,501,548,551: n=a, g, c or t
aaaaaattcagtgattagtaaactaaatttttattattttccttctcaaaaagaggaaataactttccatgaggttgcaggggaggattgaaggacaggtgacactgtggcaggagtaggtgctctaagtgtgagccccttgaaagtacaatttatttgtgctttgtagggcctggcctcatttcttccacttctattttatgntagggcattgctgaacacttctgattttttggctaaggggataaaataacacctaagtttatgattggcagttcagatcacatggtgctctgatattccatggtgagtctgaccaaaccacagaatctaggccagcttcaaggattagtaggaatgatgattaggacttgatcaaggttactttcattttagtttactacagaaccagaagacaagcaaagcacatgatagtcaccagttcgagtatggtggtatgaaatactagatactttctttcccaggctccttnnttcctcnctttttcctttgtgcctgaagttcaatggtctcagaagccaatgcangangtaagacattcagtgagataaaggagcccagaaccacaagctttctgccttttggagcattttaggttgcagagtggtgccatatagcactcaaggatccaatgtactagcatagtagaaatttcttgtatagcgactgtatgatttggctactttcacatcttatgcattactgcataatggggctgaatcaaagaattggtgcagaaagtctgaccatgccttaccacacattgtcaggctatcaataattttttttcaaaaggataataaaaactgcctaaagagaacataggtttgctccaaaaaacctaggggatgcccctatgattctcctattggagcttgccctaggctttacaccgcatcttgatcttccacagtcagtgtgagcaccattagatgcactgggtcatgggggccatgtggcagagttgtttgcactatagc

SEQ ID NO: 265 - DNA, 1001 bp, Homo Sapiens
  allele 501: 12-817-214 : polymorphic base A or G
  misc_binding 481..500: 12-817-214.mis1, potential
  misc_binding 502..521: 12-817-214.mis2, potential complement
  primer_bind 288..307: upstream amplification primer
  primer_bind 791..810: downstream amplification primer, complement
  misc_binding 489..513: 12-817-214 potential probe
gcctcctgagtagctgggattacaggcgcccaccaccacgcctgactaattctgtatttttagtagagacggggtttctccgtgttggtcaggctggtcttgaactcccgaactcagggatccgcctgccttggcctcccaaagtgctgggattataggcgtgagccacagcgcccggccattaaccaggctttaaaaagaaacagaacacttagttaacagaaccatatactctgggtaagtaatagtgcacttgtttagacacagttttttttcacttacacaattgtgagcaagttgggggaactggattgaatcaaaatataggtcacttcaaaataaagattgaaagccattgctctcaagaaatagtgcatttatccttttgtatctattttaaaatttaatccccctactcacctttctttcatagctcatcatgatttgccatatataaaactgtttatttctattgaatttatatttacaaacgtggaaaargatacagatgagaagatccaggagaagtggggagagggacaggaaggatgcatttgaattaggtcatgagcatctcagggcaggcaccctgtcttttagactttgcatacccaacaaatggcacagatgtgcacatactatatacacttaagcagttgttgagtgaattgatggtttagaaggacagacaaggaaccttaaaattggggatcagtattatggtgcagtggaaagaaccttggcccgtgagttgggaaaattaaattattggcctacctctggcctagaactcactcttttgcactacactttatccatacaatgaggagataaaacaaaatgagctctaagatctcttccaactctgacattccaggacttcaggataagataggtgttaagtgcttataattgttttacttaggagtttgagatttctggtctagattggcaaaccttgagcttatttcataaaaatgagaaaaataaggtctgggttg

SEQ ID NO: 266 - DNA, 1001 bp, Homo Sapiens
  allele 501: 12-817-355 : polymorphic base C or T
  misc_binding 481..500: 12-817-355.mis1, potential
  misc_binding 502..521: 12-817-355.mis2, potential complement
  primer_bind 147..166: upstream amplification primer
  primer_bind 650..669: downstream amplification primer, complement
  misc_binding 489..513: 12-817-355 potential probe
aagtgctgggattataggcgtgagccacagcgcccggccattaaccaggctttaaaaagaaacagaacacttagttaacagaaccatatactctgggtaagtaatagtgcacttgtttagacacagttttttttcacttacacaattgtgagcaagttgggggaactggattgaatcaaaatataggtcacttcaaaataaagattgaaagccattgctctcaagaaatagtgcatttatccttttgtatctattttaaaatttaatccccctactcacctttctttcatagctcatcatgatttgccatatataaaactgtttatttctattgaatttatatttacaaacgtggaaaaagatacagatgagaagatccaggagaagtggggagagggacaggaaggatgcatttgaattaggtcatgagcatctcagggcaggcaccctgtcttttagactttgcatacccaacaaatggcacagatgtgcacatactayatacacttaagcagttgttgagtgaattgatggtttagaaggacagacaaggaaccttaaaattggggatcagtattatggtgcagtggaaagaaccttggcccgtgagttgggaaaattaaattattggcctacctctggcctagaactcactcttttgcactacactttatccatacaatgaggagataaaacaaaatgagctctaagatctcttccaactctgacattccaggacttcaggataagataggtgttaagtgcttataattgttttacttaggagtttgagatttctggtctagattggcaaaccttgagcttatttcataaaaatgagaaaaataaggtctgggttgagttaaaatgtaggtcatttcaaaataaagaccaaaagctactactctcaagaggatgtgtttgtcctttgtgatggtgaaagaagtttgttggaaatgcagaatctcaggttctacttctgaccttctgaagcagaactt

SEQ ID NO: 267 - DNA, 1001 bp, Homo Sapiens
  allele 501: 12-819-437 : polymorphic base A or G
  misc_binding 481..500: 12-819-437.mis1, potential
  misc_binding 502..521: 12-819-437.mis2, potential complement
  primer_bind 65..84: upstream amplification primer
  primer_bind 527..546: downstream amplification primer, complement
  misc_binding 489..513: 12-819-437 potential probe
  misc_feature 144: n=a, g, c or t
ctggacaccagcttgttattgctggtttggatctttttcaaaaccgtggccttggaagcgctggtacggctgaaggagtcagagctcttgccagagtcaaagctggaacccaggctgtgattgaggccagagcttgtgaggccncagtaggccgagctcagcccatctgagcagccactggtggtctttgtatggatactcatgttctgcatcccagactccaggctgctgtccttgtcctccggcagcttcccgtaggtggtgaactcagtgtccaggggagcctggcgttcatcagctcctggcactcgcgtacctgctatgtcatgccctgcttgtcccactgcagggtggcctccagctctgccagcgtggcgttggctcctttatagccagcggcttggctctccgatggtgaaccccagggaagccctctggcctttgaggcccttagtatcagctggagccagatgatgttcgggttcatctctgagatctgcrtctttgtgcaccacagggcatccctgtgtttcccagccagtgtctgcaacccctcacacttagatctggtgccctctcagcctcgcccagctgctttggctatctcctcccacttggggacttggccatgtcactgcccacatccagtgtgcggcttttggccatagacaggaccacagatgtgtccgagtctggaggtctcctcttcatacagctgcctgaggaggctgatctcatcagtcagctctcccaagcgagactccagctctaccttgttcacttaagcttcatgcgtgtccttcttgatgaggacagattgattctccatctctgttggcttatcagtctcaccctcctacttcttcttgaagtcctccagcagcctctgcttttcctggcccagagtgtccagctgccacccaaggttgttgatgtagctatggaacacgctgtctatgttgcttccagcctcctctcctgctgctggaggctccacttgg

SEQ ID NO: 268 - DNA, 1001 bp, Homo Sapiens
  allele 501: 12-821-62 : polymorphic base T or G
  misc_binding 481..500: 12-821-62.mis1, potential
  misc_binding 502..521: 12-821-62.mis2, potential complement
  primer_bind 542..562: upstream amplification primer, complement
  primer_bind 17..37: downstream amplification primer
  misc_binding 489..513: 12-821-62 potential probe
atgtgggacaagggtgttgagcagtatgatggacttggtctattcttaacattttacatttaatacttctaaccgctgtttgaggtgggtactgttatttccattttacagatgttgaaactgaggcagagaagaaattaagctaggaagcaaggatctaaaaacaatgatttctgcctaggaagggtaggaggggtggagcttaggatttgaaaactgaaagctgatctcttaatttattctgaaacttgaaaagagacttggcaggcagtggtttaaaaagttgtttgtatcaagatttttgctatagacaagttccagggcttgaaagtaacagtacttgtaggccatgtgtttggtcattgcaggtcttgggatacacattcttaaggtactttccagtgtctggggagtttctagtctcagtggattcttgagaaacatgtgcattagttgggtgctgaagacaaaccaaagtaggagactaacaagcacttaagkgggggtttgaccccaaatctggaactttattgatcagggactatggcactatataaaactgtgtgctttcttccttagaggaaatagcaagagactaggactccctgggctggatgatcacaaagcaccttgtaaaatcagcaaagcagagcagactgttagttattatacaacaggtctacgagaccatttacagtctttattgattccacttagggggccattttgttgtaggaatattacagtgtagcaagaataattatttgccaaataggctctttttaaaatcggctttgctgaaactttgttctataaggaatctcagattatactttttaaagccttgagtccagccttggatttatctatgcctgaaaatatctgtatgagttggatgaatgttctttctctttttattttttttttttttgagacggagtctcgctctgtcgcccaggctggagtgcagtggcgcgatctcggctcactgcaagctctgc

SEQ ID NO: 269 - DNA, 1001 bp, Homo Sapiens
  allele 501: 12-821-483 : polymorphic base T or G
  misc_binding 481..500: 12-821-483.mis1, potential
  misc_binding 502..521: 12-821-483.mis2, potential complement
  primer_bind 963..983: upstream amplification primer, complement
  primer_bind 438..458: downstream amplification primer
  misc_binding 489..513: 12-821-483 potential probe
atgcttggcccaattatttgtataaagtagagcaagagtaacttttttgcatattagaaatatttattcagaataatggcattaattgcttttaatagtttagaaaagacccatcccccaaagatccagggcagctcctctaagtaaacacaatatgctgtagtaaactgtatgcatatttccactgagtaaagattataagaagcctcaggtcaggtcttaccaccaaattccaaaacacttggaatgcaggtagccagggacattggcaggttttgtcttgataagcagataagaatggtaggaatgctggttgattatcacccaatctgcttttttatacctgaagtattcacagcaacttattttaaaaagctttaaaaagttatacacctccatcccctacaacccccaatccagaatgtgggacaagggtgttgagcagtatgatggacttggtctattcttaacattttacatttaatacttctaaccgctgtktgaggtgggtactgttatttccattttacagatgttgaaactgaggcagagaagaaattaagctaggaagcaaggatctaaaaacaatgatttctgcctaggaagggtaggaggggtggagcttaggatttgaaaactgaaagctgatctcttaatttattctgaaacttgaaaagagacttggcaggcagtggtttaaaaagttgtttgtatcaagatttttgctatagacaagttccagggcttgaaagtaacagtacttgtaggccatgtgtttggtcattgcaggtcttgggatacacattcttaaggtactttccagtgtctggggagtttctagtctcagtggattcttgagaaacatgtgcattagttgggtgctgaagacaaaccaaagtaggagactaacaagcacttaagtgggggtttgaccccaaatctggaactttattgatcagggactatggcactatataaaactgtgtgctttcttccttaga

SEQ ID NO: 270 - DNA, 1001 bp, Homo Sapiens
  allele 501: 12-825-173 : polymorphic base A or C
  misc_binding 481..500: 12-825-173.mis1, potential
  misc_binding 502..521: 12-825-173.mis2, potential complement
  primer_bind 329..347: upstream amplification primer
  primer_bind 774..794: downstream amplification primer, complement
  misc_binding 489..513: 12-825-173 potential probe
  misc_feature 202: n=a, g, c or t
agaccacaaacccaccgggaggaacgaacaactccagacgtgctgccttaagagctataacactcaccacgaaggtccgcaatttcactcttgagccagcaagaccatgaacccaccagaaggaagaaactctgaacacatccgaacatcagaaggaacaaacgccggacatgccgcctttaagaactataacactcaccangagggtccgtggcttctttcttgaagtcagtgagaccaagaacccatcaattccgacacagtatgtaatcctgaattatgcacctgtcacaatttgatgaattaattgcctttgtgctgcctctgtatccttgctttcacgccactatgcttcacgccactgtaagcttgtttcaagctagcccacccccttttaaaagtgtgtattaaagtcaagtgctgtctttgttctgggcccagcttttggatgttagtccgctgggtctgagtgcactcaataaagttctcctgtctcacccmatggcctctccagtcctccttcattcctgcaacagaaggatgagtgaaatggggactcaaaacctctcactttcatttctgagccttttggtcttatggcattcctcttctttttggggggacagcaacggcacctatttttctttttacgatactggaggtggtccacacccaccccaatggtcaccagtgcactcacaagacagttgggtggggtagctccctggccccacttctttactggctggggtgcatggtggtgtctgcagcatgtgtgtgtggtgtccagtagccacacagggcataaatgagccacagccactgcccaggctccaaggcgccggcatggctggctggcgttccctaccaggtgcctgcagtctccccctccccattccagggagtctagctctgtcccacagcaattaagctcctctctctggtggaggaaccatttgcataggaataagaggttcttcccccaggcatccttatctcct

SEQ ID NO: 271 - DNA, 1001 bp, Homo Sapiens
  allele 501: 12-826-312 : polymorphic base G or A
  misc_binding 481..500: 12-826-312.mis1, potential
  misc_binding 502..521: 12-826-312.mis2, potential complement
  primer_bind 792..811: upstream amplification primer, complement
  primer_bind 337..357: downstream amplification primer
  misc_binding 489..513: 12-826-312 potential probe
gcaaaccagtgtaagaaatgaaactgtaaagggaaaaaagtggatacgaagggaggcaggcatacttaacatgaagaaaacctggtcatttggcactctttcagttaggttctttcacttggctggaggtctggtgtgccatagcagttctgcaagcctgccagagaaatctaacgatgagagtacagtaccttcattgtctaaacttcctcccaactagttaagtgaaactagctaaatgagcagtgctggcttattccttcggagtcatattttttaacatgtgaaatataattattgtaagagtccactctcttaagtttcaggatttgttggaagactgggaatagagggtggccattgccagacctgtaacttgtagagctgtgagcccagccatctcctggggcactttcccaggctctctcagaatttctgggagaaggaactgccagcttcacccctgcagtgcccccatgtctgctgggcccttgcaacttragaactggagttgggcactagagacagggcttccaggatgtgggtcttcctctggcttggccatcccaggtcagtcagctctggcaatggagggctccagctgatcttttggctgtggaaggatgactgggtagggtaccacaaggctgtccctaagttattaggttgaaccataggaaattgtcaatatttgaccattctgttcttcgaaatagtgatttcatatggttcagcttaaatttctaatatggggaaagaaaggaaagaaatggaagcccaaataatctattgcctgcactaggaagcagaatatattttccagaacattagtctctgtagggaaaagagagatcagactgttactgtgtctatgtagaaaggaagacatgagaaattccattttgatctgttctaagaaaattgctttgccttgagatgctgttaatctgtaactttagccccaaccctgtgcttacagaaacatgtgctgtatggaatca

SEQ ID NO: 272 - DNA, 1001 bp, Homo Sapiens
  allele 501: 12-831-59 : polymorphic base C or G
  misc_binding 481..500: 12-831-59.mis1, potential
  misc_binding 502..521: 12-831-59.mis2, potential complement
  primer_bind 540..559: upstream amplification primer, complement
  primer_bind 92..112: downstream amplification primer
  misc_binding 489..513: 12-831-59 potential probe
cagaacatggcaacatcaaggtcatggtcttggtgttagtagttggtatttggtgatcctcagtgttgctgtgcagtagaaggtgagtttgacgtgagaggaatgagtaggggagagagatcccctgaaccacctcctcactttctcggcattcattcccacctaggttttgtgagcctggaacttgagagactgttctgtagcccaggtctcctcagtttggctgttggacttgcccgagttgagggtgcagtgggtgtgaccctgggctgcccagcattcatgtggaagtgaaggaaggaggactggatcaatcccatttgaaagcatccctctctacagcgcccaccatcttccaactatactgcgtagggatactgctttgagatgtatcaaaggctttttaagtcaatgtattttctggtgtctgggagacctgacattctgtggcagaatgaaaatctgtcaagttttttcctgttaaatatgatgaaactgcasgatcacaaagttatgtggcttacttgaggtcacacagggatgaattttgagcactgccaataaaagcaatcacaacaattattcagtaattattcataggatccatattcagtaaatattcatataattattcagtaattattcattgaccaattcataccaggcattttgctcaaaactgtccacatatttggacatcatatcttcatcataatccttaaggtaatgctattatccataagaatcagctaagaaacctgaacaagagggatagctaatcatgtatttggccatatttctactttttggtttttgtgatgctggaagaatgaccagaatgagtcacgggaagagtattccttcctgtattattttccaggacagaggtgtgccctcctagagtactgggaccaaaattcagaagtgtctgcaaccttgctttaacagtatgggaaataacctctatcacctggaatttccctggaactttggaatatgca

SEQ ID NO: 273 - DNA, 1001 bp, Homo Sapiens
  allele 501: 12-833-264 : polymorphic base T or A
  misc_binding 481..500: 12-833-264.mis1, potential
  misc_binding 502..521: 12-833-264.mis2, potential complement
  primer_bind 746..764: upstream amplification primer, complement
  primer_bind 315..335: downstream amplification primer
  misc_binding 489..513: 12-833-264 potential probe
  misc_feature 392,485..486: n=a, g, c or t
aagtttggatgagagtactaaaacaggaatggaagaatgagatagatgaaaacatcatctccagggtcccttaagcccaggcttatctatggaacacacattctgctgagctcttaacatgctttatctcatttaatcctcacagtgactctttgagttgaatatttttattggccccacactacagattaagaaactgagctgtagagaagtaatttgtccaaggccacacaactttttaagtggtagagtgtggttcatacccaggtctgaaattaaagtctatgcctttagccaaacaactatttagtccatggggaagaagtcagaaaatcagaattgagaatcaagtctaggtattctcttcaccagagactaattgttcctgcctnaggggcaatagcataattgtttaagagcatagactcaggtcaggagccagatttctgggttcaaattctgactttgatatttacaagctatgnnaccttgagcaaattwctcagcctctctgttcctcaaatttatcctctgtaaaatggagataataatagaactaggattaagttactatcctagagcacctagaataatgcttggcataagttggcaccatattaatattgactagattagtcaatattatataatatatataagatgtccatgttggtgcatctcagtagcacagagaggcaaaagcaagtgtgtttattctagcaggcatactcaggaagaaaagtcagacctttggtactgagttagtcaaacattaattgagggcagcttctttcgctagatctctaccaaatggcactgtatgtttgctccagtaaaatctctttgcattctagcttatcaagtcataaaacaaggacctaactaaattccagtcattttcagggcactccctatagggaacttaagcttttaaaatattgcaggtaagtgagcattacactttggggtcaaagcaagcattaatcttggggtcacgccta

SEQ ID NO: 274 - DNA, 1001 bp, Homo Sapiens
  allele 501: 12-833-279 : polymorphic base G or A
  misc_binding 481..500: 12-833-279.mis1, potential
  misc_binding 502..521: 12-833-279.mis2, potential complement
  primer_bind 761..779: upstream amplification primer, complement
  primer_bind 330..350: downstream amplification primer
  misc_binding 489..513: 12-833-279 potential probe
  misc_feature 407,500..501: n=a, g, c or t
tggtaagagaagctaaagtttggatgagagtactaaaacaggaatggaagaatgagatagatgaaaacatcatctccagggtcccttaagcccaggcttatctatggaacacacattctgctgagctcttaacatgctttatctcatttaatcctcacagtgactctttgagttgaatatttttattggccccacactacagattaagaaactgagctgtagagaagtaatttgtccaaggccacacaactttttaagtggtagagtgtggttcatacccaggtctgaaattaaagtctatgcctttagccaaacaactatttagtccatggggaagaagtcagaaaatcagaattgagaatcaagtctaggtattctcttcaccagagactaattgttcctgcctnaggggcaatagcataattgtttaagagcatagactcaggtcaggagccagatttctgggttcaaattctgactttgatatttacaagctatgnnaccttgagcaaattactcagcctctctgttcctcaaatttatcctctgtaaaatggagataataatagaactaggattaagttactatcctagagcacctagaataatgcttggcataagttggcaccatattaatattgactagattagtcaatattatataatatatataagatgtccatgttggtgcatctcagtagcacagagaggcaaaagcaagtgtgtttattctagcaggcatactcaggaagaaaagtcagacctttggtactgagttagtcaaacattaattgagggcagcttctttcgctagatctctaccaaatggcactgtatgtttgctccagtaaaatctctttgcattctagcttatcaagtcataaaacaaggacctaactaaattccagtcattttcagggcactccctatagggaacttaagcttttaaaatattgcaggtaagtgagcattacactttggggtcaaagcaagcattaatc

SEQ ID NO: 275 - DNA, 1001 bp, Homo Sapiens
  allele 502: 12-833-280 : polymorphic base T or C
  misc_binding 482..501: 12-833-280.mis1, potential
  misc_binding 503..522: 12-833-280.mis2, potential complement
  primer_bind 762..780: upstream amplification primer, complement
  primer_bind 331..351: downstream amplification primer
  misc_binding 490..514: 12-833-280 potential probe
  misc_feature 408,501..502: n=a, g, c or t
atggtaagagaagctaaagtttggatgagagtactaaaacaggaatggaagaatgagatagatgaaaacatcatctccagggtcccttaagcccaggcttatctatggaacacacattctgctgagctcttaacatgctttatctcatttaatcctcacagtgactctttgagttgaatatttttattggccccacactacagattaagaaactgagctgtagagaagtaatttgtccaaggccacacaactttttaagtggtagagtgtggttcatacccaggtctgaaattaaagtctatgcctttagccaaacaactatttagtccatggggaagaagtcagaaaatcagaattgagaatcaagtctaggtattctcttcaccagagactaattgttcctgcctnaggggcaatagcataattgtttaagagcatagactcaggtcaggagccagatttctgggttcaaattctgactttgatatttacaagctatgnnaccttgagcaaattactcagcctctctgttcctcaaatttatcctctgtaaaatggagataataatagaactaggattaagttactatcctagagcacctagaataatgcttggcataagttggcaccatattaatattgactagattagtcaatattatataatatatataagatgtccatgttggtgcatctcagtagcacagagaggcaaaagcaagtgtgtttattctagcaggcatactcaggaagaaaagtcagacctttggtactgagttagtcaaacattaattgagggcagcttctttcgctagatctctaccaaatggcactgtatgtttgctccagtaaaatctctttgcattctagcttatcaagtcataaaacaaggacctaactaaattccagtcattttcagggcactccctatagggaacttaagcttttaaaatattgcaggtaagtgagcattacactttggggtcaaagcaagcattaat

SEQ ID NO: 276 - DNA, 1001 bp, Homo Sapiens
  allele 501: 12-833-373 : polymorphic base G or A
  misc_binding 481..500: 12-833-373.mis1, potential
  misc_binding 502..521: 12-833-373.mis2, potential complement
  primer_bind 855..873: upstream amplification primer, complement
  primer_bind 424..444: downstream amplification primer
  misc_binding 489..513: 12-833-373 potential probe
  misc_feature 15,501,594..595: n=a, g, c or t
aagaacttttctatnttgagtaaacaagcattgttttagtaattatatattaatgtgatttttaaaggttttaagtgcatatggtagtaatccatggtaagagaagctaaagtttggatgagagtactaaaacaggaatggaagaatgagatagatgaaaacatcatctccagggtcccttaagcccaggcttatctatggaacacacattctgctgagctcttaacatgctttatctcatttaatcctcacagtgactctttgagttgaatatttttattggccccacactacagattaagaaactgagctgtagagaagtaatttgtccaaggccacacaactttttaagtggtagagtgtggttcatacccaggtctgaaattaaagtctatgcctttagccaaacaactatttagtccatggggaagaagtcagaaaatcagaattgagaatcaagtctaggtattctcttcaccagagactaattgttcctgcctnaggggcaatagcataattgtttaagagcatagactcaggtcaggagccagatttctgggttcaaattctgactttgatatttacaagctatgnnaccttgagcaaattactcagcctctctgttcctcaaatttatcctctgtaaaatggagataataatagaactaggattaagttactatcctagagcacctagaataatgcttggcataagttggcaccatattaatattgactagattagtcaatattatataatatatataagatgtccatgttggtgcatctcagtagcacagagaggcaaaagcaagtgtgtttattctagcaggcatactcaggaagaaaagtcagacctttggtactgagttagtcaaacattaattgagggcagcttctttcgctagatctctaccaaatggcactgtatgtttgctccagtaaaatctctttgcattctagcttatcaagtcataaaacaaggacctaactaaattcca

SEQ ID NO: 277 - DNA, 990 bp, Homo Sapiens
  allele 483: 12-834-183 : polymorphic base A or G
  misc_binding 463..482: 12-834-183.mis1, potential
  misc_binding 484..503: 12-834-183.mis2, potential complement
  primer_bind 306..326: upstream amplification primer
  primer_bind 737..757: downstream amplification primer, complement
  misc_binding 471..495: 12-834-183 potential probe
  misc_feature 408,477,596: n=a, g, c or t
tctgtcacccaggctggagtgcagtggtgcaatctcggctcactgcaaactccaccttcccaggttcacaccattctcctgcctcagcttcccgagtagctggaactacaggcgcctgccaccatgcccagctaattttttgtatttttagtagagacggggcctcaccgtgttagccagaatggtctcgatctcctgaccttgtgatttgcccgcctcggccttccaaagtgctgggattacaggcgtgagccaccgcgcccggcctggaatatttacttttttgattggacacatcaatattaactctgggaaaaacttccatctcactctgggaaaaagtgcaatataaggttatcgatagtcacaaggaaaagcatgcaaaagagaacaggatagttcaaaacntggctttggtagaaagaaatccataataaaaaaggaaaacattccaaccattttattttttctcagtcnaacaartgaacagtgtaaaacaaaccatagctttgcggctgaagcattatatcagcaagtttacaaagaggaatttattacgggagtattaatgaaggaggggagttgattagttaaangaagtgactctagattgactccaggaatgacttccaaacccatgctacagaactgggccgccaaggagctgctggctcaggaagctgcctgctgaatgaggagccatagccacagctggctgctccaggaccatggcacagtctgcacaagcaaacgcacatccccatcaccctccctctttccacatacggctgggctctcatatccaagtctcagtgaggtgcatctgactggcagagccttaaccacaacaaattcctaaccgcaagggactctgggaaataaagttctaacattttccaacctttgcacattagcagctgattctaccacagtgacaattcctaatcctacgtgaagtcttccaacctggaagttaaagaaattgtggct

SEQ ID NO: 278 - DNA, 1001 bp, Homo Sapiens
  allele 501: 12-835-54 : polymorphic base A or G
  misc_binding 481..500: 12-835-54.mis1, potential
  misc_binding 502..521: 12-835-54.mis2, potential complement
  primer_bind 449..468: upstream amplification primer
  primer_bind 879..898: downstream amplification primer, complement
  misc_binding 489..513: 12-835-54 potential probe
  misc_feature 785: n=a, g, c or t
aagcctcttttacctgaaaacaaaaacacaactatcccaggaggagggaggctctcagggtaagagaaaggaagcatcaactcatcttcacagtgggtgtgtagattcagaaaaattctgaagcaatgtgttattcccagcagattaccccaaactctcattcagaaggtgcccagtgccaggaaatgatctgagtcactgtatttgggatggatgtgtatgtgtattgagggaaagggttatggcaccttcctcgctttggcctcattgctcatttagtagggagctgtatgaggaaaataaaaatggtatttatggcttgaaatcccacatggctctttgtgccaacaaaaacacacggatcccacaatctgacctgctaaaactgctgtctaggcttcaggggttgcagcccaatggctcccaaggggcaaaactgccattatgccaacagtcatcaagaggaaccatctggaaaattccactcattctgctacatgrctgagttgtaaaaagtagatcccgcccctccccacacccagttacaaaaaaagaatgaatagcagtgcagaaagtcagtttccaacacgctgcagagctgaccctgaaaaacatcatttttctctcttggacccactcccttgtccaagtcccctgaacagcggccaactacctgtgatttaatagttttctacctaacccatctcactaggagaccgaggacaagtctacaaacctctctcattcaaatttgaccaattcgtgattggtcaagtaattgttcnaagtcccttctccagctcttaaccccacagggatagttgtgaatagaaattcattcacttggcaaatattagcaagggctaccatgtgaatggcaccaagcaatgttctgtataaaggcaggtacgaagaagcagatgaccacagtgcctgctcaagaagattacaatctagattgaaagataatagataaagcaggccaggcgcggtggctcacg

SEQ ID NO: 279 - DNA, 1001 bp, Homo Sapiens
  allele 501: 12-836-134 : polymorphic base C or T
  misc_binding 481..500: 12-836-134.mis1, potential
  misc_binding 502..521: 12-836-134.mis2, potential complement
  primer_bind 368..386: upstream amplification primer
  primer_bind 909..929: downstream amplification primer, complement
  misc_binding 489..513: 12-836-134 potential probe
  misc_feature 288,545..552,602..603,605,624,795: n=a, g, c or t
gtgagccgagatcatgccactgcactccagcctgggcgacagagcgagactccgtcaacacaacagagcattggcaagggagacatgtgatgggcacctctggtcactgttgataggtatgtaattcacacgacctttcagaaaggcaaaagttagcaatatgtacctgaatcctttaatgtgttttctttgacccagtatttctattcctaagaatttctcttagcaaaataatcaaagatacttatgatattcatatacaaagctatttgatgcagcattatttanaatagctaaaacctaaagaaaacctcaatattcaacaatggggtcatggttaaataagttatgtttagattgtttagatgtacatgggatgctatatggcccatcaaaaccatcactttgaaaaatattaaatgagatggggaaatgtctatgtaaagtaaagcagactgcaaaattggtatataatcggattcctttcttttctaaatatgygtgtctgcttgagtgcatgcctgcaaagacacacacacacacannnnnnnngagagagagagagagagagagcaagagtgagagcaagagcaagcgagcgnnangagagagagagagagaganaaactaaagggaatacacccagctgtatttagtttccagagtaggagttactggccagggaaattgttgctccagaaagacgtttatgagactattgtaattttctttatatacagtgctatattatcttaattttctatgcaattccttcctagcccacctacatgcacnttgcactttcacaatccataaaattttaaataatatattttgaaagagcctgtgtatttattgagggtctaccatgagtcaggacctgtatgagatactttttaagcatttatcttacttggacctcacaataaccctgtgaaggtattataacatccattttacagatgacaaaactaagacttaagtaactccctcaaagtccc

SEQ ID NO: 280 - DNA, 976 bp, Homo Sapiens
  allele 500: 12-836-237 : polymorphic base A or G
  misc_binding 480..499: 12-836-237.mis1, potential
  misc_binding 501..520: 12-836-237.mis2, potential complement
  primer_bind 266..284: upstream amplification primer
  primer_bind 807..827: downstream amplification primer, complement
  misc_binding 488..512: 12-836-237 potential probe
  misc_feature 186,443..450,500..501,503,522,693: n=a, g, c or t
gtcactgttgataggtatgtaattcacacgacctttcagaaaggcaaaagttagcaatatgtacctgaatcctttaatgtgttttctttgacccagtatttctattcctaagaatttctcttagcaaaataatcaaagatacttatgatattcatatacaaagctatttgatgcagcattatttanaatagctaaaacctaaagaaaacctcaatattcaacaatggggtcatggttaaataagttatgtttagattgtttagatgtacatgggatgctatatggcccatcaaaaccatcactttgaaaaatattaaatgagatggggaaatgtctatgtaaagtaaagcagactgcaaaattggtatataatcggattcctttcttttctaaatatgcgtgtctgcttgagtgcatgcctgcaaagacacacacacacacannnnnnnngagagagagagagagagagagcaagagtgagagcaagagcaagcgagcgnnangagagagagagagagaganaaactaaagggaatacacccagctgtatttagtttccagagtaggagttactggccagggaaattgttgctccagaaagacgtttatgagactattgtaattttctttatatacagtgctatattatcttaattttctatgcaattccttcctagcccacctacatgcacnttgcactttcacaatccataaaattttaaataatatattttgaaagagcctgtgtatttattgagggtctaccatgagtcaggacctgtatgagatactttttaagcatttatcttacttggacctcacaataaccctgtgaaggtattataacatccattttacagatgacaaaactaagacttaagtaactccctcaaagtcccacagcacttattgtttcaagatttaaacccagatatcaagatagtctccttccttccttccctccttccttccttcc

SEQ ID NO: 281 - DNA, 979 bp, Homo Sapiens
  allele 476: 12-836-238 : polymorphic base A or T
  misc_binding 456..475: 12-836-238.mis1, potential
  misc_binding 477..496: 12-836-238.mis2, potential complement
  primer_bind 242..260: upstream amplification primer
  primer_bind 783..803: downstream amplification primer, complement
  misc_binding 464..488: 12-836-238 potential probe
  misc_feature 162,419..426,476..477,479,498,669,971..972: n=a, g, c or t
cacacgacctttcagaaaggcaaaagttagcaatatgtacctgaatcctttaatgtgttttctttgacccagtatttctattcctaagaatttctcttagcaaaataatcaaagatacttatgatattcatatacaaagctatttgatgcagcattatttanaatagctaaaacctaaagaaaacctcaatattcaacaatggggtcatggttaaataagttatgtttagattgtttagatgtacatgggatgctatatggcccatcaaaaccatcactttgaaaaatattaaatgagatggggaaatgtctatgtaaagtaaagcagactgcaaaattggtatataatcggattcctttcttttctaaatatgcgtgtctgcttgagtgcatgcctgcaaagacacacacacacacannnnnnnngagagagagagagagagagagcaagagtgagagcaagagcaagcgagcgnnangagagagagagagagaganaaactaaagggaatacacccagctgtatttagtttccagagtaggagttactggccagggaaattgttgctccagaaagacgtttatgagactattgtaattttctttatatacagtgctatattatcttaattttctatgcaattccttcctagcccacctacatgcacnttgcactttcacaatccataaaattttaaataatatattttgaaagagcctgtgtatttattgagggtctaccatgagtcaggacctgtatgagatactttttaagcatttatcttacttggacctcacaataaccctgtgaaggtattataacatccattttacagatgacaaaactaagacttaagtaactccctcaaagtcccacagcacttattgtttcaagatttaaacccagatatcaagatagtctccttccttccttccctccttccttccttccctccttccctttctttccnnttttttt

SEQ ID NO: 282 - DNA, 998 bp, Homo Sapiens
  allele 498: 12-836-257 : polymorphic base A or G
  misc_binding 478..497: 12-836-257.mis1, potential
  misc_binding 499..518: 12-836-257.mis2, potential complement
  primer_bind 242..260: upstream amplification primer
  primer_bind 783..803: downstream amplification primer, complement
  misc_binding 486..510: 12-836-257 potential probe
  misc_feature 162,419..426,476..477,479,498,669,971..972: n=a, g, c or t
cacacgacctttcagaaaggcaaaagttagcaatatgtacctgaatcctttaatgtgttttctttgacccagtatttctattcctaagaatttctcttagcaaaataatcaaagatacttatgatattcatatacaaagctatttgatgcagcattatttanaatagctaaaacctaaagaaaacctcaatattcaacaatggggtcatggttaaataagttatgtttagattgtttagatgtacatgggatgctatatggcccatcaaaaccatcactttgaaaaatattaaatgagatggggaaatgtctatgtaaagtaaagcagactgcaaaattggtatataatcggattcctttcttttctaaatatgcgtgtctgcttgagtgcatgcctgcaaagacacacacacacacannnnnnnngagagagagagagagagagagcaagagtgagagcaagagcaagcgagcgnnangagagagagagagagaganaaactaaagggaatacacccagctgtatttagtttccagagtaggagttactggccagggaaattgttgctccagaaagacgtttatgagactattgtaattttctttatatacagtgctatattatcttaattttctatgcaattccttcctagcccacctacatgcacnttgcactttcacaatccataaaattttaaataatatattttgaaagagcctgtgtatttattgagggtctaccatgagtcaggacctgtatgagatactttttaagcatttatcttacttggacctcacaataaccctgtgaaggtattataacatccattttacagatgacaaaactaagacttaagtaactccctcaaagtcccacagcacttattgtttcaagatttaaacccagatatcaagatagtctccttccttccttccctccttccttccttccctccttccctttctttccnntttttttctttttcttttttcttttt

SEQ ID NO: 283 - DNA, 1001 bp, Homo Sapiens
  allele 501: 12-836-275 : polymorphic base A or C
  misc_binding 481..500: 12-836-275.mis1, potential
  misc_binding 502..521: 12-836-275.mis2, potential complement
  primer_bind 227..245: upstream amplification primer
  primer_bind 768..788: downstream amplification primer, complement
  misc_binding 489..513: 12-836-275 potential probe
  misc_feature 147,404..411,461..462,464,483,654,956..957: n=a, g, c or t
aaaggcaaaagttagcaatatgtacctgaatcctttaatgtgttttctttgacccagtatttctattcctaagaatttctcttagcaaaataatcaaagatacttatgatattcatatacaaagctatttgatgcagcattatttanaatagctaaaacctaaagaaaacctcaatattcaacaatggggtcatggttaaataagttatgtttagattgtttagatgtacatgggatgctatatggcccatcaaaaccatcactttgaaaaatattaaatgagatggggaaatgtctatgtaaagtaaagcagactgcaaaattggtatataatcggattcctttcttttctaaatatgcgtgtctgcttgagtgcatgcctgcaaagacacacacacacacannnnnnnngagagagagagagagagagagcaagagtgagagcaagagcaagcgagcgnnangagagagagagagagaganaaactaaagggaatacamccagctgtatttagtttccagagtaggagttactggccagggaaattgttgctccagaaagacgtttatgagactattgtaattttctttatatacagtgctatattatcttaattttctatgcaattccttcctagcccacctacatgcacnttgcactttcacaatccataaaattttaaataatatattttgaaagagcctgtgtatttattgagggtctaccatgagtcaggacctgtatgagatactttttaagcatttatcttacttggacctcacaataaccctgtgaaggtattataacatccattttacagatgacaaaactaagacttaagtaactccctcaaagtcccacagcacttattgtttcaagatttaaacccagatatcaagatagtctccttccttccttccctccttccttccttccctccttccctttctttccnntttttttctttttcttttttcttttttagagtaaagtgaaaagc

SEQ ID NO: 284 - DNA, 1001 bp, Homo Sapiens
  allele 501: 12-838-179 : polymorphic base A or G
  misc_binding 481..500: 12-838-179.mis1, potential
  misc_binding 502..521: 12-838-179.mis2, potential complement
  primer_bind 323..342: upstream amplification primer
  primer_bind 895..915: downstream amplification primer, complement
  misc_binding 489..513: 12-838-179 potential probe
  misc_feature 281,667: n=a, g, c or t
gtgtatgctcactgcagaaagtgtgtgtaggtgggataggacaggcaggaggtgttaaaggaatgataaatggaaagaataaaggatatgttgtgggtgagtttgctcaataaaaatctctacaggtcctaggtttgggttattactactccttcgggaaaaagaggtggccctcgtctaaaaggagacaatcagacagtatgttcttgtgaatgttcaacccacttttctccattgctcacattccaatcacattctggctacaaaagataaaacagggntgggattcacttttatctttctgagaagctctaagtacagaggaaaaaaatttgacctctggcaagtcatgccaaaattgagagggaaaaaaatcaagatgatagggccacagcgtctaggtgagaaaagcctctgatagaacattagctcatctagtttcccactgagattccaactcatctgaaaaacggtatgttcactctaatggtagctactgtrtatttttttaaatgcatgaaagtgggaattagccaggcgtggtggcgcatgcctgtaatcccagctacttgggaggctgagacaggagaatcgcttgaacccaggaggggcaggttgcagtgagccgagatcatgccactgcactccagcgtgggcaagagagcangactccatctcaaagaaaaattaaaaataaatgcatgaaagtgggcaaagtctggaaggggttatataaaatgaaaataaatttcataacatggaaatagtcatgttatcaatgttttctttagcatcgttacattgtcctttcaataagaggggaaataatttcagttagctctctggacacagaactcgacctgctcagtgtaaaaatcgcatttgccatgttacccaaagcagctaatcaatgagcagcccctgcattgccggctcttcctgcaaaagctcaagctactcccttcaatctcttctgggcatttccattaaggccctgatga

SEQ ID NO: 285 - DNA, 1001 bp, Homo Sapiens
  allele 501: 12-839-397 : polymorphic base G or A
  misc_binding 481..500: 12-839-397.mis1, potential
  misc_binding 502..521: 12-839-397.mis2, potential complement
  primer_bind 877..897: upstream amplification primer, complement
  primer_bind 448..468: downstream amplification primer
  misc_binding 489..513: 12-839-397 potential probe
  misc_feature 808: n=a, g, c or t
ctatttctgagctctgtgttcttttccagtaacctatttgtctgttttttctttcttcaccaattccacactgttttggttactttagctttataattagtactgaagttggcagtgtcagttctctggggatttttctgatctttactatgagtacctggttgggctcctggtggtaaaacttagaaaactgtgagttccccctaagtctgggccccaagtttttaatgctcaagccaggccaccctcagcttctagaaatctgtcagtatcatttatgtgctctttccagttgctggcttcagcatgttctcttcctgctaacctctggttccctgtatttgcctgtctgtttagttttcagggtggcaatttgccctgtgacctctcctctagtccatctaagaagggttgataattttcagtttgttgagcttttttcttgttgtgaggacaagtggtgacttcctaactctttacatgttggagtagaaaccggaratttcatttaaaaaattacttgtaataaaagtcattaactgtaaatgtagaatttagtcatttaagtagatatatagaattttgcagccatcacctcagtcccctcttagaatacatttcttaccttcccaaattctccagagcctctttgcggttattttctaatccctggtcaccatgatggagcctgaacaaaataaaaatttggaaaacagacaacattaaatttaaacttttattagattggaattttatgtaatggaccattgtcttacttttgtggcaactagaagagatattgtattcntaaggactttctttgggggaacttaatagtagtcctgtttattgctgtccttgaattggttcattcgtgctgctgactgatagttgctatcaaaccttatctggtgagcacaagtgaaagagctaaaaaaaaaatcttctattagaaatgtagatgatgaatttacagataatgttatgtggagttaagtatt

SEQ ID NO: 286 - DNA, 1001 bp, Homo Sapiens
  allele 501: 12-840-47 : polymorphic base C or G
  misc_binding 481..500: 12-840-47.mis1, potential
  misc_binding 502..521: 12-840-47.mis2, potential complement
  primer_bind 527..547: upstream amplification primer, complement
  primer_bind 98..118: downstream amplification primer
  misc_binding 489..513: 12-840-47 potential probe
agttatccctcccccggaagactgaagtccctggggcgggtaggagcgcacgctaggagtagtatgaataaagtgttttcttggaggtcatgggcaagtctctggacagggttgatagtgctgatttatagagggcagtctgggcacaaagagcatttatacgatcgaaaagctgctttccctgccaacagccccataccctccccaggagcgcgcttacgccttaaaagactcttttgttatgtaaactgacagttaaattaaacgaaggtaatggatactaaaggcgtaacaggtattgtaactattttactgttatcgatgcttttgaggttacttacctcgcttgtattcgtatggtgggaatactaggcgcataccttctgagcttcgaattcagtaacctcactgggaccttgaaatcggactgggttggagtattcccattactcagataatgcaaatccgggccatcatacccctttatttttaaatgcttascagtatgccatagccctagtccatcctaaggtgaagactctaatgggttttttttgagacagagtctcgcagagatactgctattgcacttcagcctgggcaacatactgatgccccatctcaaaaaagcaataaattaaaaagaaaactcgaatgacctgaatgcattagatattttgccttgattcctttcccatgaacaactccagcagtttgtcagtaggtaagaacacctagatacattttaagcctacactattaactgggggaaggtgtaacattctgagagaaagggaattggggagagaaggcaatgcagttaggaggggccccttggaatcctagagctactgaaccgaagatcaggcataaaggatggttgttgagattctgtaattctaagaggttgtattctgatatctcctaagcaccccccccaacctcccacattccctttatctcagttgtcttcctttttaatatattaatagtattgcagt

SEQ ID NO: 287 - DNA, 1001 bp, Homo Sapiens
  allele 501: 12-840-77 : polymorphic base T or C
  misc_binding 481..500: 12-840-77.mis1, potential
  misc_binding 502..521: 12-840-77.mis2, potential complement
  primer_bind 557..577: upstream amplification primer, complement
  primer_bind 128..148: downstream amplification primer
  misc_binding 489..513: 12-840-77 potential probe
gggcgtacgcagtgctccgtgtccccaagtagttatccctcccccggaagactgaagtccctggggcgggtaggagcgcacgctaggagtagtatgaataaagtgttttcttggaggtcatgggcaagtctctggacagggttgatagtgctgatttatagagggcagtctgggcacaaagagcatttatacgatcgaaaagctgctttccctgccaacagccccataccctccccaggagcgcgcttacgccttaaaagactcttttgttatgtaaactgacagttaaattaaacgaaggtaatggatactaaaggcgtaacaggtattgtaactattttactgttatcgatgcttttgaggttacttacctcgcttgtattcgtatggtgggaatactaggcgcataccttctgagcttcgaattcagtaacctcactgggaccttgaaatcggactgggttggagtattcccattactcagataatgcaaatccgggycatcatacccctttatttttaaatgcttaccagtatgccatagccctagtccatcctaaggtgaagactctaatgggttttttttgagacagagtctcgcagagatactgctattgcacttcagcctgggcaacatactgatgccccatctcaaaaaagcaataaattaaaaagaaaactcgaatgacctgaatgcattagatattttgccttgattcctttcccatgaacaactccagcagtttgtcagtaggtaagaacacctagatacattttaagcctacactattaactgggggaaggtgtaacattctgagagaaagggaattggggagagaaggcaatgcagttaggaggggccccttggaatcctagagctactgaaccgaagatcaggcataaaggatggttgttgagattctgtaattctaagaggttgtattctgatatctcctaagcaccccccccaacctcccacattccctttatctcagttgtct

SEQ ID NO: 288 - DNA, 502 bp, Homo Sapiens
  allele 445: 12-841-445 : polymorphic base G or C
  misc_binding 425..444: 12-841-445.mis1, potential
  misc_binding 446..465: 12-841-445.mis2, potential complement
  primer_bind 1..21: upstream amplification primer
  primer_bind 483..502: downstream amplification primer, complement
  misc_binding 433..457: 12-841-445 potential probe
cattattatagtgtccatctggagtaacaaattcaacccctgccaaactaaaattaatagttacactcctgttttctctctcctgatccacatgtgcacactaagaaaaacctttcttttcattctattcaccctagttttcaaagccacagctctagataatcattcaagactcttctgctttctctttcccagtcagtaactccccacatccctcagtcccaatgtcctaaatatcttaaaactttacttttcattactcagtacctagttcagattctgaccatatctgacctgggcctttgcaacagtcttttaactggtttccctaccattgcatttcaccattttaattcattcgttacaccagatggagctttctaaaacctatgttcatattactcccttgcttaaaactccttaagtctcctcataaaggaaaaasgtgctgtatcattcaagtgctttcatgattctttaaagacgccacttctttagttaa

SEQ ID NO: 289 - DNA, 1001 bp, Homo Sapiens
  allele 501: 12-842-215 : polymorphic base T or C
  misc_binding 481..500: 12-842-215.mis1, potential
  misc_binding 502..521: 12-842-215.mis2, potential complement
  primer_bind 697..715: upstream amplification primer, complement
  primer_bind 248..268: downstream amplification primer
  misc_binding 489..513: 12-842-215 potential probe
  misc_feature 269,795: n=a, g, c or t
ccactttgcccttagcccaggatttgtaatctttttccatatatatatattttttaattggttcatccttccagaacccagctcagaaaatttgggaaagaaagaaaagaaaaagttttaaacccacccatctctccctcttaatataattaatggcaaattttctttcctccaaattttttaaatataatttttcctaatatacttgtaatctcagtaaaaacaaaaacaaacaaaattttaaaaatcccacaattttgctttctacntttaccacttgaaattatttagtgttcactttctccgtaatatcagttaccaccattttcaatagcagaaaaatagtccattaaactgatatactatataattagccattaaggtagatatttaaattatttccaatcttttgctgctctaaatgaaaatgtccactggaacattatgaatatagcttttcctctattttggattatttccttagaatccagtcctgattaygtaacttttaaaggacatgaatctagaagtaacccaacaagacaattcatcacagattactatgtattgaccaaaacatgtcaactgagaggcagaatagtatgtataagctttggagttatgaatttgaactcatctcattagccactggtctcatcttaaacaagtaacactaggatccatcagttccactgtccttttatggatacagagctaattaaatacttttaggaattagaatgactcccttaactgtgggttctcctgattttaacttttaaagtctgggattcngttaaatccaagaaactttttttgagtcctactacatgccctggttctatgtgagggacaggtaaaacagagagaagacttagaccctgccttcaagtgttagcagccttggatgtgaaaaatactacaagagaaatagatacaggcatagaacggatgactttcagggaaaactttgaaatgatggagtgatttcctacggataa

SEQ ID NO: 290 - DNA, 999 bp, Homo Sapiens
  allele 499: 12-842-447 : polymorphic base G or A
  misc_binding 479..498: 12-842-447.mis1, potential
  misc_binding 500..519: 12-842-447.mis2, potential complement
  primer_bind 927..945: upstream amplification primer, complement
  primer_bind 478..498: downstream amplification primer
  misc_binding 487..511: 12-842-447 potential probe
  misc_feature 499: n=a, g, c or t
ggtctcagctacttgggaggctgaggaacaagagttgcttgaaccagggaggtggaggttgcagtgagccaagactgcaccactgcactccagtccgggcaacagagtgagattctgtctcaaaaacaaacaaacaaaaaactctacagaataaaaacgtcctggctgaaaaaaaggaagtcctgactttggagtatcagagggttggggatacatgatcagggttgaaaccactttgcccttagcccaggatttgtaatctttttccatatatatatattttttaattggttcatccttccagaacccagctcagaaaatttgggaaagaaagaaaagaaaaagttttaaacccacccatctctccctcttaatataattaatggcaaattttctttcctccaaattttttaaatataatttttcctaatatacttgtaatctcagtaaaaacaaaaacaaacaaaattttaaaaatcccacaattttgctttctacntttaccacttgaaattatttagtgttcactttctccgtaatatcagttaccaccattttcaatagcagaaaaatagtccattaaactgatatactatataattagccattaaggtagatatttaaattatttccaatcttttgctgctctaaatgaaaatgtccactggaacattatgaatatagcttttcctctattttggattatttccttagaatccagtcctgattatgtaacttttaaaggacatgaatctagaagtaacccaacaagacaattcatcacagattactatgtattgaccaaaacatgtcaactgagaggcagaatagtatgtataagctttggagttatgaatttgaactcatctcattagccactggtctcatcttaaacaagtaacactaggatccatcagttccactgtccttttatggatacagagctaattaaatacttttaggaattagaatgactcccttaactgtgggttctcctga

SEQ ID NO: 291 - DNA, 1001 bp, Homo Sapiens
  allele 501: 12-844-167 : polymorphic base T or C
  misc_binding 481..500: 12-844-167.mis1, potential
  misc_binding 502..521: 12-844-167.mis2, potential complement
  primer_bind 649..667: upstream amplification primer, complement
  primer_bind 245..265: downstream amplification primer
  misc_binding 489..513: 12-844-167 potential probe
  misc_feature 551,561: n=a, g, c or t
gctgggacttcaggtgcatgccaccacacccggctaatttttgtatttttaatagagatggggtttcactgtgttggccaggctggtctcaaactcctaacttcgtgattctcccgcctcggcctcccaaagtgctgggattacaagcgcaagccactgcgcccggcccatgtagttctttaaaaacattttagtaatttgcctaccttaaattcaggagatttcttataacaacctgaatttttggcttctcttgaaactgtgggaaggtctaaaaatcctctgccctctttcctatatggccacaatagataggaactgggtagggattacctccaagggcattctctctttaagtacttgtgatcagcagctcaaaggcatttgaactgactggtgcctggcacacagaacatcttacccaataactgcacatagcaatgataagagccagcaggggtcaagtccttctcatgtggaggagatagaaaagcaagaacycaatactgagcattactaaccacatcatctaagaactcctgtaactgaangtagagcatncagtaatcttagccattcaccggaaacatttaggcccattcatcagaaatgtttcaagctagtgaacaagaatgtgttttcatgcctgtcatatcagggcattcagttacatactcaaaaggaagtccttgaatcaggaagatggctctggtcaaacaacgtttctatggtttgtcttttcctttttctaatacatctagaaaagtctaattttaaaatactccaaggatgcctcgttgatcttatttggggaagggaagaataggaatgtttgaaattctcaaaataatcttaaaacataattaaggtaaatatttgatttaactaaacactctgtcatttagtagggaatgagcaaagtggcaagaaccaagtagcaatttgggggacttcagccccttactcccacaaagacaccccactccccaataaatattcat

SEQ ID NO: 292 - DNA, 1001 bp, Homo Sapiens
  allele 501: 12-845-364 : polymorphic base G or A
  misc_binding 481..500: 12-845-364.mis1, potential
  misc_binding 502..521: 12-845-364.mis2, potential complement
  primer_bind 843..863: upstream amplification primer, complement
  primer_bind 415..435: downstream amplification primer
  misc_binding 489..513: 12-845-364 potential probe
  misc_feature 501: n=a, g, c or t
tggaaagattgtgtaagtgtatgtattgtattttcaccactaatatagtaacttggttacagttgcttggtaactatacactgttctaagtaatccttaaaaactggctctggtgaatgcccacagagatttttccacctctttttgcagcctctagttctcactactgtaacagggcaacaaaaatcccatagtccttatgtcatacctttgcccacactcctcctttgtgtttggcatccactcatagcactcttttgccaagttctgcaagttaggaattcgaacccatggcatgaaaacacttctaatagctcttaaaattactatttttagatatttatgggcaaaatttcaacactgctgtcccttattaaaggagaataattaaataaatttcatattttgagtggaagacacctgaccacactgaacttggatgttttagttccctactctgagaggcgggctcagtggaatcctaggacattagggctggangaaatagggaactccctgctcagaacagagggctcccccaggacaaaaccctgctgtgtgttttctgtgtgactttacgtaaattagttaagctcctcaagactcagttttcttatctgtaaaggcagataacactagttcctaactcatagtgttgtaggtgtggagaatgaaatgagaggatgggtgtacaacaacaagaacattgggtacccaaggcaagtgattggatggaacaagcagtaaagatcacgtgtgctccaaggtcacccaactttaaaggtctgaagcaaatgtgcagggggtgccatcagtggctagagtttatgaattaggggtctctacatgcttggtcgtccatgcagttcttatttatttattttgagacagagtctcactctgtcgcccaggctggagtgcaatggcgcagtctcggatcactgcaacctccacctcctggtttcaagtgattctcccgccttagcctcctgagtagctgg

SEQ ID NO: 293 - DNA, 1001 bp, Homo Sapiens
  allele 501: 12-846-209 : polymorphic base A or T
  misc_binding 481..500: 12-846-209.mis1, potential
  misc_binding 502..521: 12-846-209.mis2, potential complement
  primer_bind 294..312: upstream amplification primer
  primer_bind 786..796: downstream amplification primer, complement
  misc_binding 489..513: 12-846-209 potential probe
  misc_feature 51,61,785: n=a, g, c or t
ccaatactgagcattactaaccacatcatctaagaactcctgtaactgaangtagagcatncagtaatcttagccattcaccggaaacatttaggcccattcatcagaaatgtttcaagctagtgaacaagaatgtgttttcatgcctgtcatatcagggcattcagttacatactcaaaaggaagtccttgaatcaggaagatggctctggtcaaacaacgtttctatggtttgtcttttcctttttctaatacatctagaaaagtctaattttaaaatactccaaggatgcctcgttgatcttatttggggaagggaagaataggaatgtttgaaattctcaaaataatcttaaaacataattaaggtaaatatttgatttaactaaacactctgtcatttagtagggaatgagcaaagtggcaagaaccaagtagcaatttgggggacttcagccccttactcccacaaagacaccccactccccaataaatattcawtccaagtaaaatagtggtttttttgccattgcaaatgaggggcaagacaagtgcccaagtgccacatctcttcccagactattaccctacgtccttcctttttagaaatttccaagggacaatgaggaggttgatggctgcctatacccctctctctgaagggagttgtgaattaaatcaacaggaattaggtctcattccacagaatcattcatccctgcactagtgaatttattgcaaataatgtggctttatggtttgttttgctgaagtccatctgactnccctgttttgaacatgatacaggtgcttggttggaactgtgatcagaatttcttttttatttttattttctaaatttttatagaggtggggttttgctatgttggccaggctggtcttgaactcctggtcttatgtgatcctcccacctcagcctcccgaagtgctgagattacaggcatgaaccactgtgcctggcccagaattatttttaaaag

SEQ ID NO: 294 - DNA, 1001 bp, Homo Sapiens
  allele 501: 12-847-123 : polymorphic base A or G
  misc_binding 481..500: 12-847-123.mis1, potential
  misc_binding 502..521: 12-847-123.mis2, potential complement
  primer_bind 379..397: upstream amplification primer
  primer_bind 835..855: downstream amplification primer, complement
  misc_binding 489..513: 12-847-123 potential probe
  misc_feature 501: n=a, g, c or t
tgctgtgagcccagaggagcttcatgtcacctttaatgacccaaattagacctaagaaaattgttagccaacaatgacagcatccttacatcacgtcagcgctttaaaaagtggtgaaatttaatactcagtttgcttttgaaatcaggttcacccaacctccactcttagctgtgcattagataaatgtagaaattgcctcctttttcatcttgagtctcaaacaacagctctggactcacagctaatagacttcctgagtccaaccaattcaagcagccaatgaggcatcctggcaaatgaggacatttctccaggggatgaggctgtccttggtgcccttgctcccctctgccagcaggataggttctgtgagttatgcttctggtcacgttggtgggtttgtgctgacctgtccccagtagactcttttgtgatgaggggtgggactaatgagacgcctggccaaagtggcagaatctgtgactgtgaaagatggtnacactgccaggtataaggaaggacttaagttgatgggcaccaaacagagaactttctctatgcctgtgactggaacatgtccatcttggtagccaggtctccactacacaattcagtttttgctcccttagcagttaactgtcaaattagaaatccatcctgttttagtctttaaagccttgatataatttaactatagtcagcagaaacaaacaaatgaacaaaatccatcaataacttgtgaggctcttcctttcctataacccgaggtcatcagacataatggttaagggtgtgggtccctggaagaagactgcatggcttgaatcctggccctgttactcaccagacacataacattaagctctgggtatctcagtttcttcatctttaaaataggaataatgataattgaagactaagagtgcctcatagtaagaccttaataattaccactatctctgtttccagtcatcctcaggtagttcagtgtaatctgg

SEQ ID NO: 295 - DNA, 1001 bp, Homo Sapiens
  allele 501: 12-849-242 : polymorphic base C or A
  misc_binding 481..500: 12-849-242.mis1, potential
  misc_binding 502..521: 12-849-242.mis2, potential complement
  primer_bind 723..742: upstream amplification primer, complement
  primer_bind 293..312: downstream amplification primer
  misc_binding 489..513: 12-849-242 potential probe
ttttataatcagtatgatcacaattatgcaaatatttgttacatatgcataaaaagactagaaatatgaaaatgtttatctttggctcatgtatttataaatcattttttatacattgatatattttccaagccttctaagaatggaatctttgtacagattaaaaagttacaataagtgttattgttgtttttaaatttctacccaatgttgcttcctgcagaaattattctgtgaccactccaagaggacttggaagcccctcctcagtgttctcctagtatccaatagtatcctctaccattcactaagcacactggattttaattgtttgcttatctaacgcccaatacttggaactcttcagagaaagagactgattctctaatccctgaattcccaggcctaccacatacactaaagcactcctaaggtctgtggaccagatgaagaaatcagatgagtaggggtacgcaaacccaggcattcccattctaaacmcagtcgcattgcaatccctgcaacaaaagggatccgagatttcctccactggtgactgtgacctggggactgggaagtactgtatacaggaagatcttgaagagctgtccccttgaatagtcagcaccagggttgcacggaaagtaatagctgaaatccaagttgggttttcctggcaacagccaatattagtcagaggtggcacttggaggattccccaggtctgctcattcctttaggatcattcattcctcccaaggcctcccttgggaacaaaggaaaaccccagagtttgggattgggctcttttccaccaacagctgctagtagtttgtatttaaccctgagtcacaattaaaataaaagagggcgggcgggggaggggcgaggagttggtaagcatcccctaggaaacacttaggttttctctaaatttattccagaaaattcttctaaaggacttttcaaggaccacagcatactgccttggaaacttagtt

SEQ ID NO: 296 - DNA, 1001 bp, Homo Sapiens
  allele 501: 10-336-58 : polymorphic base C or T
  misc_binding 481..500: 10-336-58.mis1, potential
  misc_binding 502..521: 10-336-58.mis2, potential complement
  primer_bind 444..462: upstream amplification primer
  primer_bind 845..863: downstream amplification primer, complement
  misc_binding 489..513: 10-336-58 potential probe
ttatcagacttaaataagctgctggccataacaccctggggcctacaggcccttcctctgctccatttttttggggatatgattgaggatagcaatctctgctaggcacaaatgccacctgagaagataacccgtcttttgattttgtcttacaggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctygtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctatagtgtgcctccttcctgcttcctttgtgagatatgtgtttgcttctgacctgttgagaagctcaagtcaaagtggtgcaaaatagttgataagagttaaaagtgggccctaggagcagccacagaagtgagctatgaagactccccagtttggtagcactgtgcatgcgttatcttgtttctgtctcagactgatcctctgagaagtcagcagggcaggttttattcctcatttagagacagggaaagcaggtgtcattgaaacagtttctgtagtttacataagcacacacctaaggccaagtggaatgtgaccacaattaacc

SEQ ID NO: 297 - DNA, 1001 bp, Homo Sapiens
  allele 501: 10-336-137 : polymorphic base A or T
  misc_binding 481..500: 10-336-137.mis1, potential
  misc_binding 502..521: 10-336-137.mis2, potential complement
  primer_bind 365..383: upstream amplification primer
  primer_bind 766..784: downstream amplification primer, complement
  misc_binding 489..513: 10-336-137 potential probe
tgattgaggatagcaatctctgctaggcacaaatgccacctgagaagataacccgtcttttgattttgtcttacaggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgwttccttccataaagaaagttcttgtaagaatcaaaagaaatggtgagctttaagtggtttgtaaaccataaaacacatcataaaagttctatctatagtgtgcctccttcctgcttcctttgtgagatatgtgtttgcttctgacctgttgagaagctcaagtcaaagtggtgcaaaatagttgataagagttaaaagtgggccctaggagcagccacagaagtgagctatgaagactccccagtttggtagcactgtgcatgcgttatcttgtttctgtctcagactgatcctctgagaagtcagcagggcaggttttattcctcatttagagacagggaaagcaggtgtcattgaaacagtttctgtagtttacataagcacacacctaaggccaagtggaatgtgaccacaattaaccaacctgggaaacaggtttcaggaacaaatgtggaaatatttttcatccttaacaataccttcttgcctttaatcctcca

SEQ ID NO: 298 - DNA, 1001 bp, Homo Sapiens
  allele 501: 10-336-232 : polymorphic base A or G
  misc_binding 481..500: 10-336-232.mis1, potential
  misc_binding 502..521: 10-336-232.mis2, potential complement
  primer_bind 270..288: upstream amplification primer
  primer_bind 671..689: downstream amplification primer, complement
  misc_binding 489..513: 10-336-232 potential probe
agaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctrtagtgtgcctccttcctgcttcctttgtgagatatgtgtttgcttctgacctgttgagaagctcaagtcaaagtggtgcaaaatagttgataagagttaaaagtgggccctaggagcagccacagaagtgagctatgaagactccccagtttggtagcactgtgcatgcgttatcttgtttctgtctcagactgatcctctgagaagtcagcagggcaggttttattcctcatttagagacagggaaagcaggtgtcattgaaacagtttctgtagtttacataagcacacacctaaggccaagtggaatgtgaccacaattaaccaacctgggaaacaggtttcaggaacaaatgtggaaatatttttcatccttaacaataccttcttgcctttaatcctccatcagacacttattcccatgttgtttcacactggctttaacgatggtgggtgtgatcttttcttgcaactagactgtaagctttttgtggctatta

SEQ ID NO: 299 - DNA, 879 bp, Homo Sapiens
  allele 379: 12-102-104 : polymorphic base A or G
  misc_binding 359..378: 12-102-104.mis1, potential
  misc_binding 380..399: 12-102-104.mis2, potential complement
  primer_bind 276..296: upstream amplification primer
  primer_bind 733..753: downstream amplification primer, complement
  misc_binding 367..391: 12-102-104 potential probe
  misc_feature 30,35..37,59,62,68,109..112,128..129,131..132,177..178,192..193391..392,395..396,401,624,700,715: n=a, g, c or t
attatgggattacaaacattttatggtttngtctnnntaactttctttttcatgctttntanaattantgctgtgaataggtactacttagggagaaagtaagctactnnnnatacacacaatagagnngnnggtagtgacttgtgtggggtaatgtagcccaggtggggtgaggannacattcacataggnnagggggtggtggaagctgagtgctggcctcagagcacaaatggtatgaggtggagtctgcacagggtggctgtggcagtgatgagaggtaagttatatacaagggatactgatccaataagtaaatatattgaggataatgagaggaagttgcaaataaagaaagggagaaaatcgaactttgtgrtgttggattggnntcnnatgtnatctacaatgaactcagattttcaataggtgaatcaataaatgtagaaatgtagatgtaaatatgggtatatatatttggtgtatatatatatatatacttggtgtgtatatatatatattttatatatgtacacacacacacttttggacatatacccacattatatacatacatatatttcttagctctgcccactgatataagctaggggcaacaacatnctggagagcaatgagcatgcctaatgcccagatcttgatttctacatattattatccactaaaagaaaccaggacnttttggaaaaaaatnggctgattccagggctggggaagggaaagtattataaacctggaatagattgttgtgcccaaagtcaggaaatatcagcttgattgggcatctaatggtcaaatctggaatattttgagcatcagaacaagtaatgatagtaacagattataaccctttgaata

SEQ ID NO: 300 - DNA, 886 bp, Homo Sapiens
  allele 386: 12-102-111 : polymorphic base A or G
  misc_binding 366..385: 12-102-111.mis1, potential
  misc_binding 387..406: 12-102-111.mis2, potential complement
  primer_bind 276..296: upstream amplification primer
  primer_bind 733..753: downstream amplification primer, complement
  misc_binding 374..398: 12-102-111 potential probe
  misc_feature 30,35..37,59,62,68,109..112,128..129,131..132,177..178,192..193391..392,395..396,401,624,700,715: n=a, g, c or t
attatgggattacaaacattttatggtttngtctnnntaactttctttttcatgctttntanaattantgctgtgaataggtactacttagggagaaagtaagctactnnnnatacacacaatagagnngnnggtagtgacttgtgtggggtaatgtagcccaggtggggtgaggannacattcacataggnnagggggtggtggaagctgagtgctggcctcagagcacaaatggtatgaggtggagtctgcacagggtggctgtggcagtgatgagaggtaagttatatacaagggatactgatccaataagtaaatatattgaggataatgagaggaagttgcaaataaagaaagggagaaaatcgaactttgtggtgttggrttggnntcnnatgtnatctacaatgaactcagattttcaataggtgaatcaataaatgtagaaatgtagatgtaaatatgggtatatatatttggtgtatatatatatatatacttggtgtgtatatatatatattttatatatgtacacacacacacttttggacatatacccacattatatacatacatatatttcttagctctgcccactgatataagctaggggcaacaacatnctggagagcaatgagcatgcctaatgcccagatcttgatttctacatattattatccactaaaagaaaccaggacnttttggaaaaaaatnggctgattccagggctggggaagggaaagtattataaacctggaatagattgttgtgcccaaagtcaggaaatatcagcttgattgggcatctaatggtcaaatctggaatattttgagcatcagaacaagtaatgatagtaacagattataaccctttgaataaaaacag

SEQ ID NO: 301 - DNA, 1001 bp, Homo Sapiens
  allele 501: 12-102-275 : polymorphic base A or G
  misc_binding 481..500: 12-102-275.mis1, potential
  misc_binding 502..521: 12-102-275.mis2, potential complement
  primer_bind 227..247: upstream amplification primer
  primer_bind 684..704: downstream amplification primer, complement
  misc_binding 489..513: 12-102-275 potential probe
  misc_feature 10,13,19,60..63,79..80,82..83,128..129,143..144,342..343,346..347352,575,651,666: n=a, g, c or t
tcatgctttntanaattantgctgtgaataggtactacttagggagaaagtaagctactnnnnatacacacaatagagnngnnggtagtgacttgtgtggggtaatgtagcccaggtggggtgaggannacattcacataggnnagggggtggtggaagctgagtgctggcctcagagcacaaatggtatgaggtggagtctgcacagggtggctgtggcagtgatgagaggtaagttatatacaagggatactgatccaataagtaaatatattgaggataatgagaggaagttgcaaataaagaaagggagaaaatcgaactttgtggtgttggattggnntcnnatgtnatctacaatgaactcagattttcaataggtgaatcaataaatgtagaaatgtagatgtaaatatgggtatatatatttggtgtatatatatatatatacttggtgtgtatatatatatattttatatatgtacacacacacacttttgracatatacccacattatatacatacatatatttcttagctctgcccactgatataagctaggggcaacaacatnctggagagcaatgagcatgcctaatgcccagatcttgatttctacatattattatccactaaaagaaaccaggacnttttggaaaaaaatnggctgattccagggctggggaagggaaagtattataaacctggaatagattgttgtgcccaaagtcaggaaatatcagcttgattgggcatctaatggtcaaatctggaatattttgagcatcagaacaagtaatgatagtaacagattataaccctttgaataaaaacaggaatcccatgcatttaactgatatcaataaatgagtgaataaataaatggggaggggagcaagcatttcccttagtaaagtgttaactaataaatgtggaagaaatgacagaattttaaaaatcgcgatttggtagccatcagcaattaataatatggtcaaga

SEQ ID NO: 302 - DNA, 767 bp, Homo Sapiens
  allele 501: 12-103-202 : polymorphic base C or T
  misc_binding 482..500: 12-103-202.mis1
  misc_binding 502..521: 12-103-202.mis2, potential complement
  primer_bind 301..318: upstream amplification primer
  primer_bind 733..751: downstream amplification primer, complement
  misc_binding 489..513: 12-103-202 potential probe
acatacatcctcctcagcttatgaagatgatgggattaagagattaaagtaaagacaggcataggaaatcacaagggtattgattggggaagtaataaagtgtccatgaaatcttcacaatttatgttcttctgccatggcttcagccggtccctccattcggggtccctgacttcccgcaacacataactccatatgttcactgatttagcttccttcaactcagttttagaactggaagttttccaggctgggtgggcaggggttccccagcccttctctctggtccagtgctccctccttcatgggcattcctacctcacccaccacccaccccatcctaccagggcccttcatgtgcagcgcctttgacgtggacagtggtttttccttagcttaacgttgctctcccactctggggcatctgccagtgcagctcctcttcaggatacgttatccctccaggactcctcttgttgcgatccaagacaaccccacgcyggctgtgccacagggcccacatggagtcccacacccttgtctccgtgtgagaagcactgcagtctcctccaacagagcccccactccttagctaccactggagcctcacccaacctcttgcctagaggaattttcaggcgtctgtgtgccactgattcttgcctccccagagaaatatagagcacaggtaactcccttttggcttgaagcctctcagctggtgaggggaaaccatgtacctctcctgctttgtgggagacgggtgg

SEQ ID NO: 303 - DNA, 755 bp, Homo Sapiens
  allele 501: 12-103-214 : polymorphic base A or G
  misc_binding 481..500: 12-103-214.mis1, potential
  misc_binding 502..521: 12-103-214.mis2, potential complement
  primer_bind 289..306: upstream amplification primer
  primer_bind 721..739: downstream amplification primer, complement
  misc_binding 489..513: 12-103-214 potential probe
ctcagcttatgaagatgatgggattaagagattaaagtaaagacaggcataggaaatcacaagggtattgattggggaagtaataaagtgtccatgaaatcttcacaatttatgttcttctgccatggcttcagccggtccctccattcggggtccctgacttcccgcaacacataactccatatgttcactgatttagcttccttcaactcagttttagaactggaagttttccaggctgggtgggcaggggttccccagcccttctctctggtccagtgctccctccttcatgggcattcctacctcacccaccacccaccccatcctaccagggcccttcatgtgcagcgcctttgacgtggacagtggtttttccttagcttaacgttgctctcccactctggggcatctgccagtgcagctcctcttcaggatacgttatccctccaggactcctcttgttgcgatccaagacaaccccacgccggctgtgccacrgggcccacatggagtcccacacccttgtctccgtgtgagaagcactgcagtctcctccaacagagcccccactccttagctaccactggagcctcacccaacctcttgcctagaggaattttcaggcgtctgtgtgccactgattcttgcctccccagagaaatatagagcacaggtaactcccttttggcttgaagcctctcagctggtgaggggaaaccatgtacctctcctgctttgtgggagacgggtgg

SEQ ID NO: 304 - DNA, 1001 bp, Homo Sapiens
  allele 501: 12-104-351 : polymorphic base T or G
  misc_binding 502..520: 12-104-351.mis1, complement
  misc_binding 481..500: 12-104-351.mis2, potential
  primer_bind 831..851: upstream amplification primer, complement
  primer_bind 373..393: downstream amplification primer
  misc_binding 489..513: 12-104-351 potential probe
  misc_feature 16,21..41,229,275,318,362: n=a, g, c or t
tttctaaagattgagnctttnnnnnnnnnnnnnnnnnnnnntttttttttgagacagaatcttgctctgtcgcccaggctggagtgcagtggcataatcttggctcactataacatctgcctcccaggttcaagcgattctcatgcctcagcctcccaaacagctagaactacaggcatatgccaccacacccagttaatttttgtatttttagtaaagatggggtttncactgtgttggccaggctggtctcgaactcctgaccctaggtgatnccacccacttcggcctcctaaagtgctgagattacaggtgtgnaaccactgcacccagcctgattttaaaaatacatataaatacanctgatacaaaactaaaatttggtcccctatgttaaaacatcaaggttttcttgaagtattaatctgctcttagtaatatttgcaagaggttttaatttaattctgaaatctgtttttttaaaaaaattttcagccatcktctgaactttacagcaatattttctttaatagaacttgattctgtactcttggcttttctcttgtgtctgaattattccttgtgaccaggtaattttccatgcttttactaagaatcatgtattcccacactcaatgtactagtattcttgtttgcattcatctgtaatatggtgctcactcataaccttggacacacactcttcctatgtctgattaaattaaaacaccttttcatcaggcttgacttccaggttatctaaatgagcttcccagaaggagaagcaatcacattgtaggaggtttttctttacctttttggtaactggcccaagaaacaaagattttgtgttttatcaagataattccctctgtttcatgttgcttttattattactttttattacttaggagaactgtggttagaaagagttttttcggcatccatgtaaatttatgtattgcttttgaagtcctttgattatcactctggttaaataa

SEQ ID NO: 305 - DNA, 924 bp, Homo Sapiens
  allele 439: 12-105-435 : polymorphic base A or G
  misc_binding 419..438: 12-105-435.mis1, potential
  misc_binding 440..459: 12-105-435.mis2, potential complement
  primer_bind 5..23: upstream amplification primer
  primer_bind 442..462: downstream amplification primer, complement
  misc_binding 427..451: 12-105-435 potential probe
  misc_feature 92,309: n=a, g, c or t
aggggaaaattgaggctgctttgttcttaccatctctctttctgactgagaagaatgaaattcatagaaggcaaaaaatttatctgggatgntcccaaagcagatgtgataggatgaggaccatttaaatggatcaggagatagaaatctgaagaatccaaagggttgacaaaacatcaacacaactgtctgtttttttcatcacatgcccatcttttggcatgcagttgcttttccttgctgttcctttactcttggtaaagagtcttctagaggactcttccgaagtcctcactttagaagatgtancagcttctaaagtgtgcataatcaagacaggtttcaaagtttttattgcaaatttatatttacttttcctcatttaaattcttcctgtttgatccatcaaagcagcaagcagctttatgaaatacatgarcccagttcctctctttccagttaaaatcattagattctaggagatagggctggaaagaactttgccaaaattgtaagtcagttctctcattttactactgaggtaactggcctggttggttagtgatagtcagtttgtggaagcaccagggaggggagccaagtatcctttcttccaggccaaagctttgacacctaacagtcctagtttccatgcttttaaaagcaaattcatatctgccattgcattgggatccttgcctagccgtgtaacatggttaggagagaagttatttcatgtatgtgacaaatgagataagtttagttttgcgagaatgaatggtttattaatagtcacacagttggttactgatgaagccagttctttaaccctggttcctgacttgctaggtccagtttgtcatgatatatggattcttttaggataatcttgggtatttacaataaactgacttggtatcattt

SEQ ID NO: 306 - DNA, 607 bp, Homo Sapiens
  allele 278: 12-109-149 : polymorphic base A or G
  misc_binding 258..277: 12-109-149.mis1, potential
  misc_binding 279..297: 12-109-149.mis2, complement
  primer_bind 130..148: upstream amplification primer
  primer_bind 577..597: downstream amplification primer, complement
  misc_binding 266..290: 12-109-149 potential probe
  misc_feature 459,468,542: n=a, g, c or t
agacgggtgggaggtcaagaggatctgcctgtcaatgaaaaccagagctgaactgcatttaaagcagtaaaaacaaattttagtcaggaactattgcaataggggaaaggagatttcagtatagaactgggctcaattccaaatacagtatggatgacaagtgggtatttatagccaagaagctgggttggggatggaaaacctaagaggaaatttgtggggtaaggacagattctggctaaatccactggacaggattcttgctgaaggcaaacccragtgatcaggtaccaagggtgggggatgaatatttggatcagatatcgaggggtcaggggtcgcctctaaactgacatgctgcaactgggccattaggcccaacatggaccgatgccaaggtcaatgcctagagagtttagaggagctgagtctttgtcactcctcaccacagaagcctcntctgcctcnttccattagtcctcaatgtaggcaatgggctgtaagggtgacaaaaacagttatctgaggcccctgtggcaagntctcacataggatttcaagtgccctactttacagctgtgggtttaatagcacttggcatgtgcta

SEQ ID NO: 307 - DNA, 607 bp, Homo Sapiens
  allele 326: 12-109-197 : polymorphic base A or G
  misc_binding 306..325: 12-109-197.mis1, potential
  misc_binding 327..346: 12-109-197.mis2, potential complement
  primer_bind 130..148: upstream amplification primer
  primer_bind 577..597: downstream amplification primer, complement
  misc_binding 314..338: 12-109-197 potential probe
  misc_feature 459,468,542: n=a, g, c or t
agacgggtgggaggtcaagaggatctgcctgtcaatgaaaaccagagctgaactgcatttaaagcagtaaaaacaaattttagtcaggaactattgcaataggggaaaggagatttcagtatagaactgggctcaattccaaatacagtatggatgacaagtgggtatttatagccaagaagctgggttggggatggaaaacctaagaggaaatttgtggggtaaggacagattctggctaaatccactggacaggattcttgctgaaggcaaacccgagtgatcaggtaccaagggtgggggatgaatatttggatcagatatcraggggtcaggggtcgcctctaaactgacatgctgcaactgggccattaggcccaacatggaccgatgccaaggtcaatgcctagagagtttagaggagctgagtctttgtcactcctcaccacagaagcctcntctgcctcnttccattagtcctcaatgtaggcaatgggctgtaagggtgacaaaaacagttatctgaggcccctgtggcaagntctcacataggatttcaagtgccctactttacagctgtgggtttaatagcacttggcatgtgcta

SEQ ID NO: 308 - DNA, 607 bp, Homo Sapiens
  allele 338: 12-109-209 : polymorphic base A or G
  misc_binding 318..337: 12-109-209.mis1, potential
  misc_binding 339..358: 12-109-209.mis2, potential complement
  primer_bind 130..148: upstream amplification primer
  primer_bind 577..597: downstream amplification primer, complement
  misc_binding 326..350: 12-109-209 potential probe
  misc_feature 459,468,542: n=a, g, c or t
agacgggtgggaggtcaagaggatctgcctgtcaatgaaaaccagagctgaactgcatttaaagcagtaaaaacaaattttagtcaggaactattgcaataggggaaaggagatttcagtatagaactgggctcaattccaaatacagtatggatgacaagtgggtatttatagccaagaagctgggttggggatggaaaacctaagaggaaatttgtggggtaaggacagattctggctaaatccactggacaggattcttgctgaaggcaaacccgagtgatcaggtaccaagggtgggggatgaatatttggatcagatatcgaggggtcagggrtcgcctctaaactgacatgctgcaactgggccattaggcccaacatggaccgatgccaaggtcaatgcctagagagtttagaggagctgagtctttgtcactcctcaccacagaagcctcntctgcctcnttccattagtcctcaatgtaggcaatgggctgtaagggtgacaaaaacagttatctgaggcccctgtggcaagntctcacataggatttcaagtgccctactttacagctgtgggtttaatagcacttggcatgtgcta

SEQ ID NO: 309 - DNA, 607 bp, Homo Sapiens
  allele 413: 12-109-284 : polymorphic base A or G
  misc_binding 393..412: 12-109-284.mis1, potential
  misc_binding 414..433: 12-109-284.mis2, potential complement
  primer_bind 130..148: upstream amplification primer
  primer_bind 577..597: downstream amplification primer, complement
  misc_binding 401..425: 12-109-284 potential probe
  misc_feature 459,468,542: n=a, g, c or t
agacgggtgggaggtcaagaggatctgcctgtcaatgaaaaccagagctgaactgcatttaaagcagtaaaaacaaattttagtcaggaactattgcaataggggaaaggagatttcagtatagaactgggctcaattccaaatacagtatggatgacaagtgggtatttatagccaagaagctgggttggggatggaaaacctaagaggaaatttgtggggtaaggacagattctggctaaatccactggacaggattcttgctgaaggcaaacccgagtgatcaggtaccaagggtgggggatgaatatttggatcagatatcgaggggtcaggggtcgcctctaaactgacatgctgcaactgggccattaggcccaacatggaccgatgccaaggtcaatgcctagagrgtttagaggagctgagtctttgtcactcctcaccacagaagcctcntctgcctcnttccattagtcctcaatgtaggcaatgggctgtaagggtgacaaaaacagttatctgaggcccctgtggcaagntctcacataggatttcaagtgccctactttacagctgtgggtttaatagcacttggcatgtgcta

SEQ ID NO: 310 - DNA, 1001 bp, Homo Sapiens
  allele 501: 12-113-276 : polymorphic base T or C
  misc_binding 502..521: 12-113-276.mis1, potential complement
  misc_binding 482..500: 12-113-276.mis2
  primer_bind 756..775: upstream amplification primer, complement
  primer_bind 288..307: downstream amplification primer
  misc_binding 489..513: 12-113-276 potential probe
  misc_feature 994: n=a, g, c or t
acatcataaagactaagcttaacacttcagtcaattgaggtttacaataatgtagcagattcggatacaccctttaattagtctgttttaacaaaacaaatcattaaaagtaatgttgccttgtttctacgacagtcttaaatacagcacttccaccccaatacctatttcaaatgaaaattcagctgaacagttagctaattgcttttaactcacaaaccctaaatatttgcattccactaaaagcaaaagttatttacttacaaagtgtaaatgctttaaattatggctatttccaataggcttcacacatttccataaacctagatttctcattctttggaattagatgcattagatcactagggaatctcaaccgattacagcctcctgatcccgtctgtttacattccatctgcacacactcccctagacgcaactaaacaactggtttgggatgagcatcatcaacagcaccttgtggctcatcaaacaccatcyttactcaatatgggttaagaaccacacctgaatgccagcactgatatctaagtaactctaagaggtgggatgtcattttgctgactggaatattgaacaatctggggacagatatgcctgtccagacccaacacaaattaacaaaaatcctaaacacagataaatcctaaagaaaaatgtcaactcattttctttaaagaaaatgctgtccatttagaggaggagagggccagcgagaaaaagggaaaacgacccccgactcccaacacatctttttctccatacgggaaatacaaacatctctttgaagcggcttctacaaaatcggatgttctagagtcctgaaggagcattggtccgggaactaaaacagccagccacctcctggccacctgtgtccaggtagagcaaggtagtttgaggatgcagggttaggtttcggaaagggtcttcacgcccaagcggaccaaggcaagagcgtcggcgatccagnaaagtgg

SEQ ID NO: 311 - DNA, 1001 bp, Homo Sapiens; identical to SEQ ID NO: 298
  allele 501: 12-115-57 : polymorphic base A or G
  misc_binding 481..500: 12-115-57.mis1, potential
  misc_binding 502..520: 12-115-57.mis2, complement
  primer_bind 445..463: upstream amplification primer
  primer_bind 901..921: downstream amplification primer, complement
  misc_binding 489..513: 12-115-57 potential probe

SEQ ID NO: 312 - DNA, 1001 bp, Homo Sapiens
  allele 501: 12-119-26 : polymorphic base T or C
  misc_binding 502..521: 12-119-26.mis1, potential complement
  misc_binding 482..500: 12-119-26.mis2
  primer_bind 509..526: upstream amplification primer, complement
  primer_bind 41..61: downstream amplification primer
  misc_binding 489..513: 12-119-26 potential probe
  misc_feature 16,302,400,469,679: n=a, g, c or t
tgattattttttattnaccgcttgagaaaaatacatttgaaactgtcgttacaaaatgtggcattctgaagcctctacatgtatatcagttgaaaatacattgaagtgatatttgcctaaggagctagaatatcttgctttcccttcatgtgttagataagtatagcctatatataatataatacatcttaaaacgtcaaaatgttagagggaagaagtttatccgatcatttatggacactagaaaagggggcttcttaatcataagcattaacaaattgggctataagaacaaagaacanaaaatgttccggaatgccaggaaagatgtgcaaagggtttactaaacgctcttgcagaaaattccttgaagctcatggctagtaaaatgtttgaaacngatttaacccagtaaatgagtacttcctaatgtgatttgggaatattccccaaagatctttaaaacaanaacgaccaagaaataatgaaaaacaaaactaytgggtaggacctagccttatacagaaaagagggagctgcacatttcattaaaggatttgccactataaaaagatttccttcccagcgctttgggaggcagaggcgggtggatcacctgaggtcaggagttcaagaccagcccgaccaacatggagaaaccccatctctactaaaaatncaaaattagccaggcatggtggcacatgcctgtaatcccagctactcgggaggccaaggcaggagaatcgcttgaacctgggagacagaacttgtggtgagccgagatcatgccattgcactccagcctgggcaacaagagcaaaactccgtctgaaagaagaaaaaaaaaaagtttcctggccaagcgcggtggctcacgcctgtaatcccagcactttggaaggccaaggcaggaggatcatgaggtcaagagatcgagaccatcctggcctggtgaaaccccgtctctacatctctactaaaaatacaaaaattagcca

SEQ ID NO: 313 - DNA, 1001 bp, Homo Sapiens
  allele 501: 12-347-308 : polymorphic base A or G
  misc_binding 481..500: 12-347-308.mis1, potential
  misc_binding 502..521: 12-347-308.mis2, potential complement
  primer_bind 195..213: upstream amplification primer
  primer_bind 636..656: downstream amplification primer, complement
  misc_binding 489..513: 12-347-308 potential probe
tctctggagaaccccgactaatacaatgggtgattcattcaggactctcaatgcaaacaacagaacattctctagcctgtataagcaggaaggaatttattataggacattacatagctcatggagccactgggaggaccagggaattaggcttggagggtttgcacctaggaatggtggccactgtccagtggagatgcctctactactgccatggacacagcatctcaaatgacacctttgctgcccaaaccccactactgctgccttccaaaacaggctgcttctacagccacttttgctggaaaatggaatctgtgtgatacttgcttcctctcttttctctacttagaattaaaattatctttattttgtgtcggattggtggagcccagctcatgtgtctgtactgcagctacaagaaagaatggaaagtgagttttctggtttgtgccttgaaaaggaggaacccatgataaggaaaattcctcatacataggraaggtgttcaaaggggctgggaaacgtggaaagtctgcttcagtgaatctgaattttcttagttctgttctgcctctgtgggccctatccctagaatgttacaaagaccatcacaatggccttactgttgacctggtagcagctcgatatagttgcaagcaaagagcttaagaagtgaagttatgtaattatagaacaacagagaaacaaagactgttgggtacacacagtccactcttttagtaatttttgagttaaaaaaagtgtcagaaacgcaggaggcagagcaagaaggcagaatagaagcttctaccaattgtcttccccacaggaacaccaaatttaacaactgtctacacaaaaaatgcaccttcattagaaccaaaattcaagtgaatgattgtagtacctggttttaactttatattactgaaagaggcactgaggagggtaggaaggatggtcttgaattgccagagccatccctccccgatccctgg

SEQ ID NO: 314 - DNA, 1001 bp, Homo Sapiens
  allele 501: 12-354-334 : polymorphic base G or A
  misc_binding 502..521: 12-354-334.mis1, potential complement
  misc_binding 482..500: 12-354-334.mis2
  primer_bind 816..834: upstream amplification primer, complement
  primer_bind 307..327: downstream amplification primer
  misc_binding 489..513: 12-354-334 potential probe
  misc_feature 278: n=a, g, c or t
ttattaaccacgtttttacaggtgggggaactgaggtccacaaagggcagtttgctgcttaaggtcacactgagaggtcaggtggggtggaggactgggatttgaagagatattggattgagtccagagccttcctgcctgactgagaagctgcctacacaggtggggccgggtggggctgggtccatgagtgattcaggtaagagtcagctctggttttccaaatagtgggtggggcccagcaggagtgagacctctccaggagcattacaatccangctgtagctagggtgagcaggagggcacgtgattggtgtggataatggggagggggctatgcagagagaaatcctatcccttgttaccagtggggtatagggaaggaggtccttgctgccttagctgggaagggctcagggcctggggtgaagctgggcctgtgggacagctgggggtgctggcccatgggacaagctggagaaggcagggaaactgaggcargcagtgatacttttggtggccgtcacagcagatgggtggttggcagtcacttcgatgaggctggtgctggacctggtctgtttttttaatgcattcactactcttttagatactcattcatttctttgttcaagcaacaaacattccctggatgtcttttatccgccagatcctatgcttggccttggggctacaagagtgaccaggactcttatagcctcataatgtttgggggcagagggacaatgtgatcaggagtggcactgctgtggccagggaaggcacaggggcttcctagaggagagaagggggaggaggaggcatgttagaggaggcctaccaggggacatgggaggtggacttgccctataagtggaagctcacaatcttgaggactaggatggtgacaccagtcctaggcatttagactatagctttgcagtagggagcaggaaaaggtggccctgtgctgtggtctctttcccagggctggggcaagg

SEQ ID NO: 315 - DNA, 1001 bp, Homo Sapiens
  allele 501: 12-357-140 : polymorphic base C or T
  misc_binding 481..500: 12-357-140.mis1, potential
  misc_binding 502..520: 12-357-140.mis2, complement
  primer_bind 362..381: upstream amplification primer
  primer_bind 794..814: downstream amplification primer, complement
  misc_binding 489..513: 12-357-140 potential probe
gccagctgtgccaaggctgcccgggtgcctgcacctgctctcgccagcaccagttgggtctgtgggccgggagagggcttccccaccagcaggctcttccagctgctgggcccagttgtctggatctggtgcggtggtgcttaggtgtggggactggggcccaggccaaaccagtcagggttccccaccttttttttttttctctctggctgccaggtccccagagactctctaaatattactctttaggggatttgggtcctgcctcttcactgggcaatcttgcagcctgacacctctgcatcctggaggacttggtgttccctggctgtgcctgtcccctagtcacgctcagtcctggacctggagccctgacttttgggctagggggtgttccttgcccaaacccttggaaaggtcctggaaccaggcagttctggacagtcctcatctgtggggatggggactagcagcttggcctttgggctgcgtgtgtctggyatgcagcgtggtgtgctgatcatctctgcctccgcgtgtcttggggactcagtgagagcaaatgggaaggttctctgctgatggggcagttgtgggagggttgtattgatacaaataatggagagggacagattggctctacccagagtagagggcctggacgtcgaaaggaaggcctcctttagcccgcctgctaaacccccttcatgggatatacagaaaaatgaggctccagaggtgggagggactcacccaagaatgcacagccagtaagagcagccactctctaatacagctctcccaagcaactacttggtgcctggccctgtgctgagtatgggggactcaaagtgaattagacttggtacctgcatctccttggttttctttcttgatgaacaggggtgtcctccactgagcatagaactgagttggcgtgaaaacatgcaggattgaagttagaccgaaggaaggccttcctgtacgaatacttcctaaag

SEQ ID NO: 316 - DNA, 1001 bp, Homo Sapiens
  allele 501: 12-361-320 : polymorphic base G or T
  misc_binding 481..500: 12-361-320.mis1, potential
  misc_binding 502..520: 12-361-320.mis2, complement
  primer_bind 182..200: upstream amplification primer
  primer_bind 677..696: downstream amplification primer, complement
  misc_binding 489..513: 12-361-320 potential probe
tttcaccctcagctgctctggcctttcactacccttttgacctgcaataaccagttgcacaaagaatccatattccctgtaacgttggctctgagcccagataaggaagtatgtttgcagaaaggagcccggcgttttctgtgtaaggtcagagatggagcctcctgccaggcgctaggagtttttggtctgcccagctctgttctgtttccttggccaagttatcacctgtccctgaacctcagtttccttcactgaacagggtggtgggggtgatggtggatcctactgaacctgaggagtctgtaactttgctgctaaagaatcactgaggcagatttagcaagggggtggtggtctgagggatctgggttagatgccaagagggatttccttatagagtttctccaggaggcagcagggcggatgccagagctccatgcaccctcccaggagattttctagccctatctctcctattcccttggtctgtgaccttcktctggatcctagagcccagaccccaccctgatgtgggccaagtctgattccatcaggaatgggggctaaggcagctgagaccttggagtccccctcctcctgcacacccaccctctgtccccagggttctggaaaacttctttccttagacttggctgctgaggctgtgggggtggagtggaagtgaagggatgggcatttggtctggtgagacttgtggggtgataggtctggctttccctttttctggcttcaatttccccatctgcaatgtggacattatgatacctgctcttctctaccttctgcagaaatggaggaatggtgagggatctcgttttcctagtgttcatggggtggtggtctgggagaagtccccgtcctcgtcctcgtcccttttctgaccgcccccccaccccccgccccggcctgctcttgctactgaactctgactaggcaggaagtgaacgctctagaagcccgtggctgaggagttttat

SEQ ID NO: 317 - DNA, 1001 bp, Homo Sapiens
  allele 501: 12-361-388 : polymorphic base A or G
  misc_binding 482..500: 12-361-388.mis1
  misc_binding 502..521: 12-361-388.mis2, potential complement
  primer_bind 114..132: upstream amplification primer
  primer_bind 609..628: downstream amplification primer, complement
  misc_binding 489..513: 12-361-388 potential probe
catattccctgtaacgttggctctgagcccagataaggaagtatgtttgcagaaaggagcccggcgttttctgtgtaaggtcagagatggagcctcctgccaggcgctaggagtttttggtctgcccagctctgttctgtttccttggccaagttatcacctgtccctgaacctcagtttccttcactgaacagggtggtgggggtgatggtggatcctactgaacctgaggagtctgtaactttgctgctaaagaatcactgaggcagatttagcaagggggtggtggtctgagggatctgggttagatgccaagagggatttccttatagagtttctccaggaggcagcagggcggatgccagagctccatgcaccctcccaggagattttctagccctatctctcctattcccttggtctgtgaccttcgtctggatcctagagcccagaccccaccctgatgtgggccaagtctgattccatcaggaatgggggctraggcagctgagaccttggagtccccctcctcctgcacacccaccctctgtccccagggttctggaaaacttctttccttagacttggctgctgaggctgtgggggtggagtggaagtgaagggatgggcatttggtctggtgagacttgtggggtgataggtctggctttccctttttctggcttcaatttccccatctgcaatgtggacattatgatacctgctcttctctaccttctgcagaaatggaggaatggtgagggatctcgttttcctagtgttcatggggtggtggtctgggagaagtccccgtcctcgtcctcgtcccttttctgaccgcccccccaccccccgccccggcctgctcttgctactgaactctgactaggcaggaagtgaacgctctagaagcccgtggctgaggagttttatcagctctttcttaactttcagtgtcacagccggggaatcttctcctgccgccgtttggtggcaatagg

SEQ ID NO: 318 - DNA, 1001 bp, Homo Sapiens
  allele 501: 12-365-251 : polymorphic base G or C
  misc_binding 482..500: 12-365-251.mis1
  misc_binding 502..521: 12-365-251.mis2, potential complement
  primer_bind 252..270: upstream amplification primer
  primer_bind 697..717: downstream amplification primer, complement
  misc_binding 489..513: 12-365-251 potential probe
caaatagaaattaagataaacctaaataaaataaattaagtaacattcagttcttcattcacactagccaaatttctagtgctcagtagctacacgtggctagtggctaccacattggatcgtacaaatcttaggcaagcaccaaaacaaagtttgatgctgaatctttagggctaagaacagtacttggcatgtagtagtctcttggcatgtatttactgaatgaatgaagaagctgccatataattaggtacacttgtagctgccaccaaggagaagctgtgagtgccactagagtgtttggatgatgggtaaaacttccctaggaagttacaaataaacccagagttgcataaaggatgaggaggagttagggatgctaagaatgggagagggctttccaggtagagggtttagcaagtacaaaagcttagaggtggagaacagcttggtgacttggagggagtgtaaaaatgggagcgtttgctgagcctagtgatsgagcgtaagaatgactttacaggaaggtggagatgtctgtggggaccgtgttaaggaattctactttctgccaagagcagagagagtatttggaaaggttttaagtcagctcatgatgcaagatttgttgttttttttttttaagttttttttttcttttttgcttgggtgcagtgcagagactggcctgtctggggataggagtggaaatagggagcccacttagggaaaggagtcagagtggaagatgagcgggggttgcttgaggtagtgatggtagagatggagagcaggggactgattttaagagacattttggaggtggaatcaacagccttggctgaggggaactggcagctggaggcaggagtgggagggagttggttgtgggcagctgcgggtgacccccaaccccaggttgccaggtggccccatcccacaggtgctggatggagaaatgtacccgccctcggtagaagaggcgcctgtgttgatgcact

SEQ ID NO: 319 - DNA, 1001 bp, Homo Sapiens
  allele 501: 12-374-261 : polymorphic base G or A
  misc_binding 502..521: 12-374-261.mis1, potential complement
  misc_binding 482..500: 12-374-261.mis2
  primer_bind 741..761: upstream amplification primer, complement
  primer_bind 262..280: downstream amplification primer
  misc_binding 489..513: 12-374-261 potential probe
accatcctggctaatacggtgaaaccccgtctctactaaaaatataaaaagttagctgggcaaggtggcgggcgcctgtagtcccagctactggggaggccgaggcaggagaatggcgtgaacccgggagacagagcttgcagtgagccaagatcgcgccactgcactccagcctgggtgacagggcgagactctgtctcaaaaaaagaaaagaaaagaaaagaaaactgggtgcagtcacccaaagaagagggaaggggcacgggacaggcagaaacagctgatgaccaccagcactgcgtttctccatttgacaaagaatccaaagctccaagaggggaagtgtcttttgtctggagcctcggagctggtaggttaggagccttactggccctgggtcctgggcctggatggagagaagggggagggccatgtggtgagggcactcttgcatgtccagagcctagcttgcttcagacctcctcaagagagagggagagrggtttgcaaggatgccggaagccaaaactgcttcttctccatacttcttggtatttgcttaagcaggaaaagaccttcgtgtttattgagcaaccaaggcatgctagatacttctggtacttcacatacataatgtctccaatcatgtttttcagaggtggaaactgaggctaagaacgtaaagcgacttgtccaagtcacacagtcttggaatggtaaggctgggacttggccgaggtctggaatgactccaatgcctgtgctcttttcttgaatattttctcaatggggtgctgttgacaatgtgtgtaggactgtcctgcgcagggcagaaatcttagctggctaacaaccaaaatttgcaacccttcctccgccccacatatccaacttccaccctcagaaagctacctctgtccctggataacaacctcaaccaccctcaccagctctggttcctttccgtgggcccagggactcacatagagaaagcatttggc

SEQ ID NO: 320 - DNA, 1001 bp, Homo Sapiens
  allele 501: 10-308-116 : polymorphic base C or T
  misc_binding 481..500: 10-308-116.mis1, potential
  misc_binding 502..521: 10-308-116.mis2, potential complement
  primer_bind 386..403: upstream amplification primer
  primer_bind 754..771: downstream amplification primer, complement
  misc_binding 489..513: 10-308-116 potential probe
ttctctgcggggcagggtatgtggttcagacgagccgcttccatccccagttctgtccctaagccctgggtgacctcagcattgagcatcgtctctgagcctcagtttcctgtctatatctagtgccaccaggcatcagaaacgtaagtgcttcaaggatcttgggtgaaaagccgctttagcggcgagcatacactaattaataaaatgccttggccggggctgggcagaggaagtaagcgggcagccgaggtgacagctggagggaggagcgggggtggagccgggggaagggtggggaggggatgggctggagctccgggcagtgtgcgaggcgcacgcacaggagcctgcactctgcgtcccgcaccccagcagccgcgccatgagccgtgagtgcgaccccggtgcccggtggggaattttcttggcctcctggtggagccttgaatgccaggctcagcccctcatctctctcctctgcagggagtctcttgctcyggttcttgctgttcctgctcctgctcccgccgctccccgtcctgctcgcggacccaggggcgcccacgccaggtaggcggccccatccctccccaagggaatccccggtcttgcgcccctggcctggtttcaaccccctcctttcccctccagcgggcccagcttcccctttctgctcgcggtgctgagaaagactgaggctgagtcttttggtgggatgggggctccctgaagcccccccggcggtgtggccttggctaatgggctatctagttctttcaggggaaacagcagactgggatctggtgccaacttggggagaagggacagtccctatccatccccctcacctgttctgggccccagatgtctaagcagcctctgcacccaacaaccccgctgtttcctataggggcctctttgggaggaagccgcaggcaccaagggaaatgagttccctttctccagcctctaaccgtctgggaacccatcctgattcc

SEQ ID NO: 321 - DNA, 1001 bp, Homo Sapiens
  allele 501: 10-311-274 : polymorphic base C or T
  misc_binding 481..500: 10-311-274.mis1, potential
  misc_binding 502..521: 10-311-274.mis2, potential complement
  primer_bind 228..245: upstream amplification primer
  primer_bind 632..651: downstream amplification primer, complement
  misc_binding 489..513: 10-311-274 potential probe
cactgcggcccagcccctctttcacccacttcctgctcactcacgggcgctggttctgggagtttgtcaatgccaccttcatccgagagatgctcatgcgcctggtactcacaggtgggtgtggggcagggccccctgacctgggggagcaagcaagcctgctagtccttttggattcttggcatctgataagggtagtgggtggggagagtctatgatgcctgataaaataagccccaacccaggaggaggcaagaactgggatggagctgggggtggaaacacccttgtcaccgttatttttgctctctgcagtgcgctccaaccttatccccagtccccccacctacaactcagcacatgactacatcagctgggagtctttctccaacgtgagctattacactcgtattctgccctctgtgcctaaagattgccccacacccatgggaaccaaaggtaaaatggggtgaggagctgggcctggggattacaggaggygctcagttcttctctttgggaaaaatcaggcgaagaacaattattgacccaattctgcagatggctagaccaaggcaagacatatgacatgtccagagcctgggctgagaacaggcaagggcagcagagggtcttgcctgaggtcacctagagtcagaccaatgtttccatagttccagggtgcctctttgcttgatccttttctaatgatcagttgggtcctgccggggtggaagtgacttagaagttgagatgtaggaaagaatagtgagctatttattgggtgctgtctctgtgtttgggtctttacagatgtaaatagttttacatgcttcaccagtgtaaggtacaaataagccacatttttttctttcgttactcaagacttcacttagccacactggcaggggtcttccttgtaagaccttcccatgccacctgtaattatccaaaaacctgggatattactcatttcagacccatcagttcagcatcaagta

SEQ ID NO: 322 - DNA, 1001 bp, Homo Sapiens
  allele 501: 10-314-76 : polymorphic base C or T
  misc_binding 481..500: 10-314-76.mis1, potential
  misc_binding 502..521: 10-314-76.mis2, potential complement
  primer_bind 426..443: upstream amplification primer
  primer_bind 827..846: downstream amplification primer, complement
  misc_binding 489..513: 10-314-76 potential probe
ttccaggtagagggtttagcaagtacaaaagcttagaggtggagaacagcttggtgacttggagggagtgtaaaaatgggagcgtttgctgagcctagtgatcgagcgtaagaatgactttacaggaaggtggagatgtctgtggggaccgtgttaaggaattctactttctgccaagagcagagagagtatttggaaaggttttaagtcagctcatgatgcaagatttgttgttttttttttttaagttttttttttcttttttgcttgggtgcagtgcagagactggcctgtctggggataggagtggaaatagggagcccacttagggaaaggagtcagagtggaagatgagcgggggttgcttgaggtagtgatggtagagatggagagcaggggactgattttaagagacattttggaggtggaatcaacagccttggctgaggggaactggcagctggaggcaggagtgggagggagttggttgtgggcagctgygggtgacccccaaccccaggttgccaggtggccccatcccacaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggtgaggactccagacctgccctgccctggaaggtcattccctccatcctgagaagttgggggcgggggggtacttagaggtggaggctgggattagaatcctcacccttctgcttagtggctagaagaccttgagcaggcccctcaacctctgtgagcctcggtctccaaatctgtacgttggggtgaacgatgattgtaaggatttat

SEQ ID NO: 323 - DNA, 1001 bp, Homo Sapiens
  allele 501: 10-306-265 : polymorphic base A or G
  misc_binding 481..500: 10-306-265.mis1, potential
  misc_binding 502..521: 10-306-265.mis2, potential complement
  primer_bind 238..255: upstream amplification primer
  primer_bind 660..678: downstream amplification primer, complement
  misc_binding 489..513: 10-306-265 potential probe
ctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggargtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagca

SEQ ID NO: 324 - DNA, 429 bp, Homo Sapiens
  allele 386: 10-52-386 : polymorphic base C or T
  misc_binding 366..385: 10-52-386.mis1, potential
  misc_binding 387..406: 10-52-386.mis2, potential complement
  primer_bind 1..18: upstream amplification primer
  primer_bind 412..429: downstream amplification primer, complement
  misc_binding 374..398: 10-52-386 potential probe
tgggcttggttttcagtcttataaaaaggaaggttctctcggttagcgaccaattgtcatacgacttgcagtgagcgtcaggagcacgtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacaggtgagtacctggcgccgcgcaccggggactccggttccacgcacccgggcagagtttccgctctgacctcctgggtctatcccagtactccgacttctctccgaatagagaagctacgtgacttgggaaagagcttggaccgctagagtycgaaagaactccgtggatattccagctttcccacaaghactga

SEQ ID NO: 325 - DNA, 438 bp, Homo Sapiens
  allele 240: 10-62-240 : polymorphic base G or C
  misc_binding 221..239: 10-62-240.mis1
  misc_binding 241..260: 10-62-240.mis2, potential complement
  primer_bind 1..20: upstream amplification primer
  primer_bind 419..438: downstream amplification primer, complement
  misc_binding 228..252: 10-62-240 potential probe
ttgcctcattaggagtggggctggatacagttatcattgtatagatttgtgtcttataatgagtcccattaatttctccctccctttcttcgtcttcttgcagcggaatttttgacaagaataaaattatttctgaaacccactccaaacacagtgcactacatacttacccacttcaagggattttggaacgttgtgaataacattcccttccttcgaaatgcaattatgagttatgtsttgacatgtaagtacaagtgtctttctaaggtttttagccttctcaaagaaaaatatgctttataatactgtaagcctaatctaaaaacatatttccaagcttatcaaaaagactttaagatagcttttaagtttgccttccatcttaatcgccaaaaatattgacatttagtcccatccagtttatacagtctgctc

SEQ ID NO: 326 - DNA, 425 bp, Homo Sapiens
  allele 276: 10-65-276 : polymorphic base A or G
  misc_binding 256..275: 10-65-276.mis1, potential
  misc_binding 277..295: 10-65-276.mis2, complement
  primer_bind 1..19: upstream amplification primer
  primer_bind 408..425: downstream amplification primer, complement
  misc_binding 264..288: 10-65-276 potential probe
ttagcarttcatbgctatgaaaaatgtatattttatttaaaaattttaaagaaagctaaatgatcaaattatttaatgatgaattatatgatagacactttatataagaaaaacttcaacagcaacaaattaaaattttttcatcattttctaggtggacttaaatcatatttacggtgaaactctggctagacagcgtaaactgcgccttttcaaggatggaaaaatgaaatatcaggtatgcttcctttgactattaagacttagttattaccrcttatacccatattttaaaatccctaaaaatgtgttccttaactttttaactgatgtttatttatttatttatttttttagataattgatggagagatgtatcctcccacagtcaaagatactcaggcagagatgtcctaccctcctca

SEQ ID NO: 327 - DNA, 422 bp, Homo Sapiens
  allele 42: 10-67-42 : polymorphic base A or T
  misc_binding 22..41: 10-67-42.mis1, potential
  misc_binding 43..62: 10-67-42.mis2, potential complement
  primer_bind 2..20: upstream amplification primer
  primer_bind 403..422: downstream amplification primer, complement
  misc_binding 30..54: 10-67-42 potential probe
gtatcctcccacagtcaaagatactcaggcagagatgatctwccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggtaaacaagaaaatgatttatataaaaccctcttccccagggaaaattagtgtgctatctttgttatgttttgagtaaatgacaagatgtggtaaatgaaaactcacacattctatatacattaaatatgtaagcatgactgataaaatagctatcttttgatactgacaaggaagaaaacagaaatgaggg

SEQ ID NO: 328 - DNA, 422 bp, Homo Sapiens
  allele 341: 10-67-340 : polymorphic base C or T
  misc_binding 322..340: 10-67-340.mis1
  misc_binding 342..361: 10-67-340.mis2, potential complement
  primer_bind 2..20: upstream amplification primer
  primer_bind 403..422: downstream amplification primer, complement
  misc_binding 329..353: 10-67-340 potential probe
gtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggtaaacaagaaaatgatttatataaaaccctcttccccagggaaaattagtgtgctatctttgttatgttttgagtaaatgacaagatgtggtaaatgaaaactcacacaytctatatacattaaatatgtaagcatgactgataaaatagctatcttttgatactgacaaggaagaaaacagaaatgaggg

SEQ ID NO: 329 - DNA, 418 bp, Homo Sapiens
  allele 264: 10-55-265 : polymorphic base C or T
  misc_binding 245..263: 10-55-265.mis1
  misc_binding 265..284: 10-55-265.mis2, potential complement
  primer_bind 1..17: upstream amplification primer
  primer_bind 405..418: downstream amplification primer, complement
  misc_binding 252..276: 10-55-265 potential probe
cactactctaaagatttgctgttgctgttaagtttggaaaacagtttttattctgttttataaaccagagagaaatgagttttgacgtctttttacttgaatttcaacttatattataagaacgaaagtaaagatgtttgaatacttaaacactgtcacaagatggcaaaatgctgaaagtttttacactgtcgatgtttccaatgcatcttccatgatgcattagaagtaactaatgtttgaaattttaaagtacttttggtyatttttctgtcatcaaacaaaaacaggtatcagtgcattattaaatgaatatttaaattagacattaccagtaatttcatgtctactttttaaaatcagcaatgaaacaataatttgaaatttctaaattcatagggtagatcacctgtaaaag

SEQ ID NO: 330 - DNA, 429 bp, Homo Sapiens
  allele 278: 10-57-278 : polymorphic base C or T
  misc_binding 259..277: 10-57-278.mis1
  misc_binding 279..298: 10-57-278.mis2, potential complement
  primer_bind 1..19: upstream amplification primer
  primer_bind 410..429: downstream amplification primer, complement
  misc_binding 266..290: 10-57-278 potential probe
atttattaaggtggtggagccactgcagtgttatcttaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataaygatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagta

SEQ ID NO: 331 - DNA, 420 bp, Homo Sapiens
  allele 176: 10-59-176 : polymorphic base C or T
  misc_binding 157..175: 10-59-176.mis1
  misc_binding 177..196: 10-59-176.mis2, potential complement
  primer_bind 1..19: upstream amplification primer
  primer_bind 401..420: downstream amplification primer, complement
  misc_binding 164..188: 10-59-176 potential probe
gctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtayggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattg

SEQ ID NO: 332 - DNA, 428 bp, Homo Sapiens
  allele 114: 10-60-114 : polymorphic base A or G
  misc_binding 94..113: 10-60-114.mis1, potential
  misc_binding 115..134: 10-60-114.mis2, potential complement
  primer_bind 1..20: upstream amplification primer
  primer_bind 409..428: downstream amplification primer, complement
  misc_binding 102..126: 10-60-114 potential probe
gacgataatacttcttttccacatctcattgtcactgacatttaatggtactgtatattacttaatttattgaagattattatttatgtcttattaggacactatggttataarctgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattga

SEQ ID NO: 333 - DNA, 307 bp, Homo Sapiens
  allele 176: 10-27-176 : polymorphic base A or G
  misc_binding 156..175: 10-27-176.mis1, potential
  misc_binding 177..195: 10-27-176.mis2, complement
  primer_bind 1..18: upstream amplification primer
  primer_bind 290..307: downstream amplification primer, complement
  misc_binding 164..188: 10-27-176 potential probe
atcacgagtgttcagtgggctgtcccgggccctgggtggaggccaagcctggcccataaataggggtctcctcagtgccctccgctcctcctgcacacctccctcgctctcccacaccactggcaccaggccccggacacccgctctgctgcaggagaatggctactcatcacacrctgtggatgggactggccctgctgggggtgctgggcgacctgcaggcagcaccggaggcccaggtctccgtgcagcccaacttccagcaggacaaggtgaggggctttcctgcgtcaccccaagggctaca

SEQ ID NO: 334 - DNA, 429 bp, Homo Sapiens
  allele 242: 10-28-242 : polymorphic base A or G
  misc_binding 222..241: 10-28-242.mis1, potential
  misc_binding 243..261: 10-28-242.mis2, complement
  primer_bind 3..20: upstream amplification primer
  primer_bind 410..429: downstream amplification primer, complement
  misc_binding 230..254: 10-28-242 potential probe
aggttgtccatgtgcaagtctgtggtggcccctgccacggatggtggcctcaacctgacctccaccttcctcaggtgggacagcgggcaggtgggtttctgggacggagaggtccagggacaccctcgggcctaacccctgaccctgaggtcacccacctacaggaaaaaccagtgtgagacccgaaccatgctgctgcagcccgcggggtccctcggctcctacagctaccggagtccccrtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagaccct

SEQ ID NO: 335 - DNA, 385 bp, Homo Sapiens
  allele 350: 10-30-349 : polymorphic base A or G
  misc_binding 330..349: 10-30-349.mis1, potential
  misc_binding 351..369: 10-30-349.mis2, complement
  primer_bind 1..18: upstream amplification primer
  primer_bind 368..385: downstream amplification primer, complement
  misc_binding 338..362: 10-30-349 potential probe
tatagtacgtgccccgtggacgccgcccacacgcaggcctgaccagagggggctccccaagacccagggcagggcacacagcatcccccccgctgaggccagctccgtctccaccctgtcccaggccgaacccagacccccagggctgagttaaaggagaaattcaccgccttctgcaaggcccagggcttcacagaggataccattgtcttcctgccccaaaccggtgaggggtcctaatctgatggggagaggatcaaggtcagattagaggcaggcaggcagtctcctgactgggggaggcagaggggaggaggtggccccgccctgctcgaggcctgggccagggrcagagggggtgagtgttcaagtcagaacctccctc

SEQ ID NO: 336 - DNA, 443 bp, Homo Sapiens
  allele 42: 10-181-42 : polymorphic base C or T
  misc_binding 23..41: 10-181-42.mis1
  misc_binding 43..62: 10-181-42.mis2, potential complement
  primer_bind 1..18: upstream amplification primer
  primer_bind 424..443: downstream amplification primer, complement
  misc_binding 30..54: 10-181-42 potential probe
  misc_feature 81: n=a, g, c or t
tctdgctatgggaggacctggccccatcagacttcagagtcyctccctggcaggtgacccaggcctgcccagacggaagcnattcagacccagagccacgtgtcctgggtctccctgccccgggccacccgccaccacaccccagagcttgctcaccaccgggaggcgctcttgtcctggaccagcctagcctgggttgggacctccagccaggccagtcagcgagccaccagccccaccagagtggaatgacagccaggactcagctggcagcgggcaggaggccagtcttgtggtgatatcccagccgcaactctcttcctgcccctcccctgtcctgacggcagcccccagctctgtagctgagccaggcttgcgggccacgcggggtcccgggtttaggcaccccacccctatctgttccaacagactctctccctctc

SEQ ID NO: 337 - DNA, 443 bp, Homo Sapiens
  allele 374: 10-181-372 : polymorphic base C or T
  misc_binding 355..373: 10-181-372.mis1
  misc_binding 375..394: 10-181-372.mis2, potential complement
  primer_bind 1..18: upstream amplification primer
  primer_bind 424..443: downstream amplification primer, complement
  misc_binding 362..386: 10-181-372 potential probe
  misc_feature 81: n=a, g, c or t
tctdgctatgggaggacctggccccatcagacttcagagtctctccctggcaggtgacccaggcctgcccagacggaagcnattcagacccagagccacgtgtcctgggtctccctgccccgggccacccgccaccacaccccagagcttgctcaccaccgggaggcgctcttgtcctggaccagcctagcctgggttgggacctccagccaggccagtcagcgagccaccagccccaccagagtggaatgacagccaggactcagctggcagcgggcaggaggccagtcttgtggtgatatcccagccgcaactctcttcctgcccctcccctgtcctgacggcagcccccagctctgtagctgagccaggcytgcgggccacgcggggtcccgggtttaggcaccccacccctatctgttccaacagactctctccctctc

SEQ ID NO: 338 - DNA, 447 bp, Homo Sapiens
  allele 259: 10-183-260 : polymorphic base G or C
  misc_binding 239..258: 10-183-260.mis1, potential
  misc_binding 260..279: 10-183-260.mis2, potential complement
  primer_bind 1..18: upstream amplification primer
  primer_bind 430..447: downstream amplification primer, complement
  misc_binding 247..271: 10-183-260 potential probe
ccctgctgctacataggcatgcgcctcccccagtctgggctccttgacccccgggcactggggaaggggaacaaggaagcagtccacaccagcccactcccagggctcgtgcgcccccagcaagggatgggccacagaatccaggaagaagacgggctccggcccccagtggtcgccagcagccccgtagaagctcaccaccccaccccatccgactcactcctgctctcatgtacatttcccagctccccacccgggstcaccttcagaccagcggcagcgctcacccaccacgcctgccagggaagctcagtcccaacagaatccagagagggcccaccacatgtgcctgcctgtgacggcctgtgacagggccccagccagggccaacgagctggaggggcccaaggagctgggtgcagcgctggggtaacaggacagccccac

SEQ ID NO: 339 - DNA, 1001 bp, Homo Sapiens
  allele 501: 10-475-163 : polymorphic base A or G
  misc_binding 481..500: 10-475-163.mis1, potential
  misc_binding 502..521: 10-475-163.mis2, potential complement
  primer_bind 340..358: upstream amplification primer
  primer_bind 739..758: downstream amplification primer, complement
  misc_binding 489..513: 10-475-163 potential probe
ggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtaagcccggcgcccagccgcggaaatttctctgcccacacactccgagactcgccccgccgcccgaggtgcactggcggagacaagggaggccgcgcccggcgtgcccactttgccacttccaaaatttgctgaagctgaggctgtgagcacacctcagaagtggctgggagggaacccaaacctaattgccaaatttcaggtccaggaggggagcctcttgtgtgtttattgtttgtccgtctatttcgtgactgcgcaggcccgcgattcctctcctcttgtctataggtagcgctggtggattggaatcttgaagcaggtgtacagtgtaaagctgccctggatgagcartttgaacctcagaagactctgttcatccagtgcgatgtggctgaccagcaacaactgagaggtaagacaggggaatcaatctgtcaactgggaacgtgctctcaacaagcaacaacctgaaggcagcccggccagggggccctgggtgccgcctccgctgcctcctcgagagcagctaccttgaagctccaaaagacagtttggactgatacgtttccttctgacagcccaatagctgtaaaaccgaaagaaaggcaagactgctggagaaatccttttattgtagtcatttggcagcattaatgtaatcaaaattcctttatgtattcaaagacagtgctgctgcagtaattattaaatgattgaaattgcagacaaaacttggaaaattaaagtaggttaagtaaggtactgttgacaaacaacttctcccagaaagctggagtccaatgacaatcaaatgtggcagtgtttttcgtttaaacatatcagaatacaag

SEQ ID NO: 340 - DNA, 1001 bp, Homo Sapiens
  allele 501: 12-884-203 : polymorphic base C or T
  misc_binding 482..500: 12-884-203.mis1
  misc_binding 502..521: 12-884-203.mis2, potential complement
  primer_bind 299..317: upstream amplification primer
  primer_bind 817..837: downstream amplification primer, complement
  misc_binding 489..513: 12-884-203 potential probe
gaagggtaaataaattttgcctccaacatttagaaaacaaaaagaatatatggaattattgaagatgttgagaattgagtgaaagtaatagacatttttggaatacaacctgtagcataaaatctcatattgggcaactaagtgaagttttgcagatatatgacaagctccacaatgattaggcaaacccaaagaatccaggtttaatgactaactttaaaaacaaagctcttttaaaacctttcattgataatatttgcagaaatctccctaggtatctggaatagctataaaaactttggtgtgtgaaaatatgggaaaggataatgactgtattccttttctcacttatgcctctggattaggtttctgttatcagtggaacctatcttggtttggattacatgagtaagcaaaatggaggtgaaggcggcatcattatcaatatgtcatctttagcaggtaagggcaattattacattaaatgtaacattttcttaytggtaatttggaccacaaaaacaaatcttcaaagcatatttattatcagctcaagttggaaattaaaaatctgatcgttttatagttccatggaattttctattgcaaaatatcaaaagtttgaaaaatatgtttatttctcttaatttaacttgtggcttttaaagttatcttactgcagtaatatttgaaaaaatatatataatttttttttagagccaatatttttcaaaggttgtggtgagactcctaagcaataatgcatgtgaaagcacctttggcaaagtaaaaagcactaaagtgaagttaagatgtctctgctcccatgtgattttagtaacagtgtgtaattttaaaatatggcatatatcatagttaagatatgttaaactaataaataaagccaaacttacatgtagtataagcacattccttactcgtacatcagtctgaggcaagatccttgttgcaggtatctcttctgtatgcagacatttgaa

SEQ ID NO: 341 - DNA, 1001 bp, Homo Sapiens
  allele 501: 10-479-266 : polymorphic base A or G
  misc_binding 481..500: 10-479-266.mis1, potential
  misc_binding 502..521: 10-479-266.mis2, potential complement
  primer_bind 236..253: upstream amplification primer
  primer_bind 638..657: downstream amplification primer, complement
  misc_binding 489..513: 10-479-266 potential probe
gtattatttgttatacaaccaccatatttgaaataacacttgggatatcgattctaagtctcagctacttagcttcaggctcctgcagagttcagtagataagagaagcttacataattgtttccaggagttgtccagtaatactgatttttaaaaaaaattaattaggtgagattttcaggaattaatacaatactttatgtatgtgttattttactatctatttaccagtcattgttacatagctgggaggatatctaattagtattttttacatcagaaaattgtaagatgctttaatgatcagtttgtcctgtgctatatgtttatgaaactgctgaaacctacaaccttctaattggcagttggctgctaatcttatgaacagtggtgtgagactgaatgccatttgtccaggctttgttaacacagccatccttgaatcaattgaaaaagaagaaaacatgggacaatatatagaatataaggatcatatcaagratatgattaaatactatggaattttggagtaagtaaaactatgtctattttcttttaaatgatgaagcaaagcattatttagacaagctataaaaagggaagaaataagcttatacagttgagaaataaacacaagcttcaaacttttggtttggcaaactctctgggagaaaatatatttttctgggtttataaatagaatgtaagtttatacattatgaatgttactttgaaatatgtaaaatgcttcattactaccatcagtcataaagttgatatttagtcacctttgaaggcaatgataccttctctgcctaaattccaagcaatattcaaatatagtctgtgaaatattgcaagtttccatgacttcaaccacttttataagaaatagttgatacacacacatacatggacacatactttctcagtgaattatgtctgaattcaagcaactgaggatttcatgaatcatagttatcatgttgaaggaatcagac

SEQ ID NO: 342 - DNA, 1001 bp, Homo Sapiens
  allele 501: 10-479-350 : polymorphic base C or T
  misc_binding 481..500: 10-479-350.mis1, potential
  misc_binding 502..521: 10-479-350.mis2, potential complement
  primer_bind 152..169: upstream amplification primer
  primer_bind 554..573: downstream amplification primer, complement
  misc_binding 489..513: 10-479-350 potential probe
gcagagttcagtagataagagaagcttacataattgtttccaggagttgtccagtaatactgatttttaaaaaaaattaattaggtgagattttcaggaattaatacaatactttatgtatgtgttattttactatctatttaccagtcattgttacatagctgggaggatatctaattagtattttttacatcagaaaattgtaagatgctttaatgatcagtttgtcctgtgctatatgtttatgaaactgctgaaacctacaaccttctaattggcagttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggagtaagtaaaactatgtctattttcttttaaatgatgaagcaaagcattatttagayaagctataaaaagggaagaaataagcttatacagttgagaaataaacacaagcttcaaacttttggtttggcaaactctctgggagaaaatatatttttctgggtttataaatagaatgtaagtttatacattatgaatgttactttgaaatatgtaaaatgcttcattactaccatcagtcataaagttgatatttagtcacctttgaaggcaatgataccttctctgcctaaattccaagcaatattcaaatatagtctgtgaaatattgcaagtttccatgacttcaaccacttttataagaaatagttgatacacacacatacatggacacatactttctcagtgaattatgtctgaattcaagcaactgaggatttcatgaatcatagttatcatgttgaaggaatcagacctgagatcaaatcttggctctaccactaaccatgaacttacccatcatacctctagatgcttcaattttctcacatataaaata

SEQ ID NO: 343 - DNA, 1001 bp, Homo Sapiens
  allele 501: 10-479-394 : polymorphic base A or G
  misc_binding 481..500: 10-479-394.mis1, potential
  misc_binding 502..521: 10-479-394.mis2, potential complement
  primer_bind 108..125: upstream amplification primer
  primer_bind 510..529: downstream amplification primer, complement
  misc_binding 489..513: 10-479-394 potential probe
agttgtccagtaatactgatttttaaaaaaaattaattaggtgagattttcaggaattaatacaatactttatgtatgtgttattttactatctatttaccagtcattgttacatagctgggaggatatctaattagtattttttacatcagaaaattgtaagatgctttaatgatcagtttgtcctgtgctatatgtttatgaaactgctgaaacctacaaccttctaattggcagttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggagtaagtaaaactatgtctattttcttttaaatgatgaagcaaagcattatttagacaagctataaaaagggaagaaataagcttatacagttgagaaatraacacaagcttcaaacttttggtttggcaaactctctgggagaaaatatatttttctgggtttataaatagaatgtaagtttatacattatgaatgttactttgaaatatgtaaaatgcttcattactaccatcagtcataaagttgatatttagtcacctttgaaggcaatgataccttctctgcctaaattccaagcaatattcaaatatagtctgtgaaatattgcaagtttccatgacttcaaccacttttataagaaatagttgatacacacacatacatggacacatactttctcagtgaattatgtctgaattcaagcaactgaggatttcatgaatcatagttatcatgttgaaggaatcagacctgagatcaaatcttggctctaccactaaccatgaacttacccatcatacctctagatgcttcaattttctcacatataaaatagagataatacaacagacttagggactttgaaaaacttaaataaa

SEQ ID NO: 344 - DNA, 1001 bp, Homo Sapiens
  allele 501: 10-482-145 : polymorphic base A or G
  misc_binding 481..500: 10-482-145.mis1, potential
  misc_binding 502..521: 10-482-145.mis2, potential complement
  primer_bind 357..374: upstream amplification primer
  primer_bind 779..798: downstream amplification primer, complement
  misc_binding 489..513: 10-482-145 potential probe
acgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcarcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagt

SEQ ID NO: 345 - DNA, 1001 bp, Homo Sapiens
  allele 501: 12-854-64 : polymorphic base A or G
  misc_binding 481..500: 12-854-64.mis1, potential
  misc_binding 502..521: 12-854-64.mis2, potential complement
  primer_bind 438..457: upstream amplification primer
  primer_bind 942..962: downstream amplification primer, complement
  misc_binding 489..513: 12-854-64 potential probe
attatagaatacatagtacatacactatttttatgtaatttatgtaacatatagtatatagttatagcatatgctatattgtctttagtatgatatatacatgtttatccaataataatttataaaatattgcaatgaaaaatgctattttcattaatattacaattacattatatatatataaacaacctaaagggactaaacaaaataataggttacttttttaggattgattgcttacgattttttcctaatttttaagcattctatattgttttactattgataagcaaaaaaaagaaataggaagaaggataactcactctgtgtatttatgcattagatatgatcaaatggttaataatttcactcaagaagaccttttaaaatcacataagttttcagttagtatgtataatgcatttgcttacttgcttcaggtaaacaagtagtaatcaagtgtaaaatttatattcttgtatttatacatttcttgatccrtgtaactctactctctaacttgaggataccatgatcctaaggatttccaaaacttgggtagagtttcttgataatttccaactgaaaaccagctctgccgacagtttagcaactagaacatgcaatgtagaaggaaagcttgagtctttcttactccttcacttttgactctaaaatttgcacctttcatcgatctggcttttgcacaatgaataaccatccagtcataaaaggttctagactcaatctaatcttaaatagcaatattgccccttctgtttgtgctgtactaaggagcaggtaatagctatggttttgaatccggtagcagtttaaagtaagataatcagtaattcactctgccaaataactgtcatacaattgttacagaaataatatttgtatcatgcatgctgatttttgactcgcaaatatcataggttagagagcactgaaaaagttttaataggtaaaatattagttttataaaactccactca

SEQ ID NO: 346 - DNA, 1001 bp, Homo Sapiens
  allele 501: 12-854-472 : polymorphic base G or T
  misc_binding 481..500: 12-854-472.mis1, potential
  misc_binding 502..521: 12-854-472.mis2, potential complement
  primer_bind 30..49: upstream amplification primer
  primer_bind 534..554: downstream amplification primer, complement
  misc_binding 489..513: 12-854-472 potential probe
gtatgtataatgcatttgcttacttgcttcaggtaaacaagtagtaatcaagtgtaaaatttatattcttgtatttatacatttcttgatccatgtaactctactctctaacttgaggataccatgatcctaaggatttccaaaacttgggtagagtttcttgataatttccaactgaaaaccagctctgccgacagtttagcaactagaacatgcaatgtagaaggaaagcttgagtctttcttactccttcacttttgactctaaaatttgcacctttcatcgatctggcttttgcacaatgaataaccatccagtcataaaaggttctagactcaatctaatcttaaatagcaatattgccccttctgtttgtgctgtactaaggagcaggtaatagctatggttttgaatccggtagcagtttaaagtaagataatcagtaattcactctgccaaataactgtcatacaattgttacagaaataatatttgtatcakgcatgctgatttttgactcgcaaatatcataggttagagagcactgaaaaagttttaataggtaaaatattagttttataaaactccactcaaaatgtaagcttttgtgaaccacatgtactcctatatgaatatttttactatttttacatcatttcatctccatgtttctccatctctggatttgtgaagtaatagttctaactatagttatgttcttagaaataaaaaagtggaaaattacctaatttatttcaagtataagaacgaatagtcatcttagtgtttacaccatatattcactctcaaaatgcatgtaaacacaaaaatcaaaaacaaaatggctactcacagctacaaattcacattctgtatgtcctgctctacccctacctccaagccaacaacagcagcaaaagaaaacaaaattcaccaaaggaccatccacagcacaaatcatcttgttttcagaaatgagaatgtatcacaaatataaatgt

SEQ ID NO: 347 - DNA, 1001 bp, Homo Sapiens
  allele 501: 12-855-194 : polymorphic base T or G
  misc_binding 481..500: 12-855-194.mis1, potential
  misc_binding 502..521: 12-855-194.mis2, potential complement
  primer_bind 674..694: upstream amplification primer, complement
  primer_bind 234..254: downstream amplification primer
  misc_binding 489..513: 12-855-194 potential probe
tcttctatatactctaacagtagagaagctcagtaatacatatgagccttctctttaaacacactcttagctttattccttggaaacgtgggtttcaatctacctatgtttctacattaggaaatacaaagaaagaagttacaaaattgttaaactaataagtggaaatagctcaaaagtatcctaagaggagttgtgaagagaaattgtattgagaaaattataactaggaaataatggcagtcagtcacatcagtgataattagccctcttttgtgaaagctgtggatgactgcaaaaggcacagaaggaaatcttcatggtgacgaaaggtttgataaaaaagaacaatggctagaagctcaagcaattacaattctttacctacagaaacagagagaaccagccaccttgaccaaaggaacatctggcacacatagaggtgagctaatttaactctgtttcaacctgaggacagcagaggcagcaattacttggctkaacttacagtgacaaaagaagacaaatgaaaaggaagcatgaatgacctggcagtacaggtgagactaataggaagagttgttgagagggtgtataaaactctaagctcttttgcacaatcatgctttctctcacttcagtttgcttcaaatgtggttctgcctaaaggaaacaagaatcttccagaactctgattcttttataacatttattacacaagttaatacagtttaataagctttcaatgtatgcttgagatgaacacaaaactatttaagtctatccaacatttattaaatgtttgtttgcttttatcacagttttgacataaaggaacttcctttccttttctgagttcaaagattttgaagcgcttcaaactatgacttttctggaaataatgtctgaaattctaaatgaaaagaaaacaatgcaattaatgtgctttattgcagaacttttaaaatcagtgcaacgccaaacaagaaaattacgtacga

SEQ ID NO: 348 - DNA, 1001 bp, Homo Sapiens
  allele 501: 12-855-288 : polymorphic base T or C
  misc_binding 481..500: 12-855-288.mis1, potential
  misc_binding 502..521: 12-855-288.mis2, potential complement
  primer_bind 768..788: upstream amplification primer, complement
  primer_bind 328..348: downstream amplification primer
  misc_binding 489..513: 12-855-288 potential probe
agtaagttgtaaagattttgctgagtagaggtttactaaagtaatgaatgccctgtgattcagttgtcgtatttgcaaaataaagaagagactatcttctatatactctaacagtagagaagctcagtaatacatatgagccttctctttaaacacactcttagctttattccttggaaacgtgggtttcaatctacctatgtttctacattaggaaatacaaagaaagaagttacaaaattgttaaactaataagtggaaatagctcaaaagtatcctaagaggagttgtgaagagaaattgtattgagaaaattataactaggaaataatggcagtcagtcacatcagtgataattagccctcttttgtgaaagctgtggatgactgcaaaaggcacagaaggaaatcttcatggtgacgaaaggtttgataaaaaagaacaatggctagaagctcaagcaattacaattctttacctacagaaacagagagaaccagycaccttgaccaaaggaacatctggcacacatagaggtgagctaatttaactctgtttcaacctgaggacagcagaggcagcaattacttggcttaacttacagtgacaaaagaagacaaatgaaaaggaagcatgaatgacctggcagtacaggtgagactaataggaagagttgttgagagggtgtataaaactctaagctcttttgcacaatcatgctttctctcacttcagtttgcttcaaatgtggttctgcctaaaggaaacaagaatcttccagaactctgattcttttataacatttattacacaagttaatacagtttaataagctttcaatgtatgcttgagatgaacacaaaactatttaagtctatccaacatttattaaatgtttgtttgcttttatcacagttttgacataaaggaacttcctttccttttctgagttcaaagattttgaagcgcttcaaactatgacttttctggaaataatgtct

SEQ ID NO: 349 - DNA, 1001 bp, Homo Sapiens
  allele 501: 12-855-423 : polymorphic base T or G
  misc_binding 481..500: 12-855-423.mis1, potential
  misc_binding 502..521: 12-855-423.mis2, potential complement
  primer_bind 903..923: upstream amplification primer, complement
  primer_bind 463..483: downstream amplification primer
  misc_binding 489..513: 12-855-423 potential probe
aaaattccctccctaaccttggaatgaaataagttagatctgagatttagatttctgtgttaaccaggctctgaaatcacctgtatagcaataattacatcactcagtattaccaatactctaattgttaatagcagtaagttgtaaagattttgctgagtagaggtttactaaagtaatgaatgccctgtgattcagttgtcgtatttgcaaaataaagaagagactatcttctatatactctaacagtagagaagctcagtaatacatatgagccttctctttaaacacactcttagctttattccttggaaacgtgggtttcaatctacctatgtttctacattaggaaatacaaagaaagaagttacaaaattgttaaactaataagtggaaatagctcaaaagtatcctaagaggagttgtgaagagaaattgtattgagaaaattataactaggaaataatggcagtcagtcacatcagtgataattagccctcktttgtgaaagctgtggatgactgcaaaaggcacagaaggaaatcttcatggtgacgaaaggtttgataaaaaagaacaatggctagaagctcaagcaattacaattctttacctacagaaacagagagaaccagccaccttgaccaaaggaacatctggcacacatagaggtgagctaatttaactctgtttcaacctgaggacagcagaggcagcaattacttggcttaacttacagtgacaaaagaagacaaatgaaaaggaagcatgaatgacctggcagtacaggtgagactaataggaagagttgttgagagggtgtataaaactctaagctcttttgcacaatcatgctttctctcacttcagtttgcttcaaatgtggttctgcctaaaggaaacaagaatcttccagaactctgattcttttataacatttattacacaagttaatacagtttaataagctttcaatgtatgcttgagatgaacacaaaact

SEQ ID NO: 350 - DNA, 985 bp, Homo Sapiens
  allele 476: 12-857-25 : polymorphic base C or T
  misc_binding 456..475: 12-857-25.mis1, potential
  misc_binding 477..496: 12-857-25.mis2, potential complement
  primer_bind 452..471: upstream amplification primer
  primer_bind 965..985: downstream amplification primer, complement
  misc_binding 464..488: 12-857-25 potential probe
aaaacaattagctgggcgtggtggcaggcacctgtaatcccagctacttgggaggctgaggcaggagaatcacttgaacctgggaggcagaggttgcagtgagctgagattgtgccactgcactccagcctgggcgacagtgcgagactctatcaaacacacacacacacacacacacacacacacacacaagaaatattatcccaaattagtcatgtatacgttgcatcctaccatatttaattaaggaatgctattttatctattctctctccataagtcacttctcaaatgacatacagagaaataaatgagtaacgtcataggttatacatgcaggtaaaatagggaagtagtgagtgctctctaatacttcagtagtaatattgccttttctttctttgctcaatttagtgtttaatttttgtggttggctttcttgttcttttttatggtagcaacacgcaagcctttaytggttttgaagtttaccctgctaaaattcttcctgtaaatacaggaacttccctctctattacagttcctgtaaatacaggaactgttaacttccctattatcagaagatcaagatcctgagacatttatttgttccttccatcatcatagcattaccagtgtatcagagtaatagtcatagaacagaacaaatgtactttttctcctttgtatttccttttaccaacttcatctgtattccatggaagtcattcctttgccttaaggtggcttcagattcctagtaaagaatgtgaaggtaaatagaatgaatattcgggcttcagatacaggagactttcgagactacaataagattatagacttaaataaaaagctttgtcaaaagaaggatgttctaaatgctttaggagcccaataatataacaaggacagaaatggtctaattgttaagatttcagtaagccacggatatttataaaccaatggagggtggaagaatatgctt

SEQ ID NO: 351 - DNA, 1001 bp, Homo Sapiens
  allele 501: 12-858-346 : polymorphic base T or C
  misc_binding 502..521: 12-858-346.mis1, potential complement
  misc_binding 482..500: 12-858-346.mis2
  primer_bind 827..846: upstream amplification primer, complement
  primer_bind 371..391: downstream amplification primer
  misc_binding 489..513: 12-858-346 potential probe
cgtctggatgagacatttaagtaaggtagcggtaacaggagtcatagagtgatagtaatattaataataaacattattaagcaatgcactaaagaccatataaacatcatcttcttagcataatcatgagagacagatatgatctccatttgacagataggaaactgagccttacagagtataactgaattaaatttccaacatcacatggctagtaagttgtggatcatggattttggcctgtgctgtcttgtaccaaaattcatactctttatacatggtactgctcattattgcattcatttatttcactcagtcaacaaataaaactgattacttacctaaaacttttctgtttgtttctgtcatagggagtaagaggagtatttggggaaatgaaagtgtagttatgaagttcctaagaaaagctaaaaagggagttactgattatacttcacactaccctccttagggatgggtttgcactcacttgacctctcytcctcctccctgcaccacccacagtgtgtcctcattagccacatgatctaactgtctgtaatatttcttatcatattagtcagctgcagtttgcttatgtttcctgcatgggattcaatgaagatattctaagattatcattcagatattcctctaggaaataaacgttcaagcagatatgtacatggtggtgatgttgtgaacgcacaattgatgcacttctggatctttgatcaactaatttaggaaggacgcggtaagctgtgaaagtaatggcagggatggaagagaaaggaagaaaggaagaaactagtatcttttgaaagtttcttgtacccagaaaagtggtaagtgccttacacttcatataatctaaccataattctaggctccagataacaatatcatctttagcctcagagttaatggaggctcagagagtaacatgcttaagttcacacagccagtaagtggagcagcctgggtacaaagctaagtct

SEQ ID NO: 352 - DNA, 1001 bp, Homo Sapiens
  allele 501: 12-858-443 : polymorphic base G or A
  misc_binding 481..500: 12-858-443.mis1, potential
  misc_binding 502..521: 12-858-443.mis2, potential complement
  primer_bind 924..943: upstream amplification primer, complement
  primer_bind 468..488: downstream amplification primer
  misc_binding 489..513: 12-858-443 potential probe
gaaaaagcggcctagtgtcctttctggaattaaagcctggggcctctgagccctttatatacaagaataggagtgtgttggaccataagacatgaaacgtctggatgagacatttaagtaaggtagcggtaacaggagtcatagagtgatagtaatattaataataaacattattaagcaatgcactaaagaccatataaacatcatcttcttagcataatcatgagagacagatatgatctccatttgacagataggaaactgagccttacagagtataactgaattaaatttccaacatcacatggctagtaagttgtggatcatggattttggcctgtgctgtcttgtaccaaaattcatactctttatacatggtactgctcattattgcattcatttatttcactcagtcaacaaataaaactgattacttacctaaaacttttctgtttgtttctgtcatagggagtaagaggagtatttggggaaatgaaagtrtagttatgaagttcctaagaaaagctaaaaagggagttactgattatacttcacactaccctccttagggatgggtttgcactcacttgacctctcctcctcctccctgcaccacccacagtgtgtcctcattagccacatgatctaactgtctgtaatatttcttatcatattagtcagctgcagtttgcttatgtttcctgcatgggattcaatgaagatattctaagattatcattcagatattcctctaggaaataaacgttcaagcagatatgtacatggtggtgatgttgtgaacgcacaattgatgcacttctggatctttgatcaactaatttaggaaggacgcggtaagctgtgaaagtaatggcagggatggaagagaaaggaagaaaggaagaaactagtatcttttgaaagtttcttgtacccagaaaagtggtaagtgccttacacttcatataatctaaccataattctaggctccagataacaat

SEQ ID NO: 353 - DNA, 1001 bp, Homo Sapiens
  allele 501: 12-860-388 : polymorphic base G or A
  misc_binding 481..500: 12-860-388.mis1, potential
  misc_binding 502..521: 12-860-388.mis2, potential complement
  primer_bind 866..885: upstream amplification primer, complement
  primer_bind 367..387: downstream amplification primer
  misc_binding 489..513: 12-860-388 potential probe
ctataatctgtataaaagagagagtctttgtctcagcattaaaaaacaaacagtaactgaggtgatagaagtgttaagtatcttgattgtggtaatcatgtcactatcatctatctgtctgtctatctatctacctaatcatcaatctatctatctaatcctcacattgtacaccacaaatttataccacgttgtcaatcagacctcaataaagctggggaaaaaaggaatgagtctttgtcaccaaatccccaagctaagtgaaagcaatgaatggaggatggcctggtgagctctggattagagaaatgcagggtctgctacccgatgcatggtcgagaagtctagaggcaaggattgcattataagagaaatatcagcatttggaatctgccatgtcagagggctccagtaggagataataactgcgccagtcaggtaagaagttttgtgccccgtatcacttccccattaatcaatctccactctcacacccaaccrttaatcagaggttgcatagtaaacacaggggaagtggaagaaacagatgaagaaagagtgcataaacaaaacctacttcttactgcagattttccagaagcaggactgaggtagggaaagagagatttaaatctgatcagatattagccgggcatggtggtgggtgcctgtgattccagcagcttgggtggctgaggcaagaggatcacttgagcctggcgggtggaggttgcaatgagctgtgatcgtgccactgcactttagccggggcaacagagcaagatctgtcttaaattaagaaaaagaaagaaatctgatcacatatggatcattttctattaggctgctctttctatgctggaaactgatgctactcattaattccagaaagtagctgacaaagctgtggaatcctcatccatggatagaaaagaacaatttggcacattaagtcaaaaggagcattagggagaaggaacaaagttactttacgtttgtgc

SEQ ID NO: 354 - DNA, 1001 bp, Homo Sapiens
  allele 501: 12-861-270 : polymorphic base C or T
  misc_binding 481..500: 12-861-270.mis1, potential
  misc_binding 502..521: 12-861-270.mis2, potential complement
  primer_bind 232..251: upstream amplification primer
  primer_bind 668..688: downstream amplification primer, complement
  misc_binding 489..513: 12-861-270 potential probe
attgagcaattgccaagctccaggcattgtggtaaactattggctttatgacatccacatctaacttttacaagtctctacaatagaggtcaatttaattatctccaatttatagttgaacaatgaatctcaaacagatcttgaagaatgtgggaattagcagtggtaataaaagcaattttattttgctccattttagcctgtgtcatagagtggatgtactgttcctatgctgtgattcataagtgctcagatgccaactgccatgagtatgggagccacccttcctgcttagtgctggcaaagttctcccaaatggactctgcagagtccattttgctctcttttggcttaaaatagtttaaaagacacatagtagaagtaatcagtaggaatgattaaatatttgtaaatgaggcattttgaaggatagatgagagattcgaggtttcttaacataggaatgagagggctactgagaaacgaatagtcttctagaayagtgcttctcagatttaatatgtctagggactttgtcagatgcagattctgatttcgataggacagagatggctcctgaaattgtgctcccaggtgataccgctccttgaaccacactttaagaagccagccactagtatgcatagggatggatattctttgaatgggtaagggagcttctgtcagtttcctctgaccacagcctaggcaatgactgaacactagtagcaactgtctgagtcactagaaattgctattaaacatatctttctgggaagatttttgttatagaatatatagtggttttatgaaagcatgtgtcacttttttttttttttttttttttttgagacggagtctcgctctgtcgcccaggctggagtgcggtggcgcaatctcggctcactgcaagctccgccttacgggttcacgccattctcctgcctcagcctcctgagtagctgagactacaggcgcccgccaccacgcctggctaattt

SEQ ID NO: 355 - DNA, 1001 bp, Homo Sapiens
  allele 501: 12-862-349 : polymorphic base A or G
  misc_binding 481..500: 12-862-349.mis1, potential
  misc_binding 502..521: 12-862-349.mis2, potential complement
  primer_bind 153..171: upstream amplification primer
  primer_bind 607..626: downstream amplification primer, complement
  misc_binding 489..513: 12-862-349 potential probe
gcccacctcggcctcccaaagtgctgggattacaggcgtcagccaccgcgcccggccgcatgtgtcactttttaatgtcgtgtcacactctaaagcataacttaatggcacccataagaatgagaaaaaaaacagccatcagataaggtgttccattatgcggaaaatcacaaatgaggaagttcaccagttactttggtcaggtgtatgcacgaatcgtagataaatatttcttgctagttctcccttttttcttcaagttggagaagtggtggttaaaacagacagacgggtacacatttttttgttgttgttggttgtaaagaaaatgtgacagctttagattcctgcttttttagcgtagttacagaactccaggttatcatacgagtatcagcatccttagattcaccatttatttccctaagttgaattttcagcatttttatatagtccattctacatggtttctctctccttaaaagcaaatcttgtttgcgratttagtatgactgctctgtctgaggaggtttctgtttttgcaaaaaaatctttttgagcttttttaccttctgtgaaatgattaaaactggcttttgtaaatatggtagaaagattatgaagaatagaagaactaatgtagagatggaatttacatttttttttctgaatgactttctttgttctattagtacacatgtaattttcagatattttaaatgctttcaggtattttaagtgctatatatattatttcgtcagtctaattgtttagtgttattatcctgagtggttttagaaaatatttctttgttttgtgggtagaatttctccctctactgatttttttttctgtaactttacagttatgacagacataaatctgctactaattatacttggtatattttaaaaagagccattgtgtatttctataaataaacttgcacaatggtgggcctatcagaggtactgaaaaatactgttcttaactattttaa

SEQ ID NO: 356 - DNA, 1001 bp, Homo Sapiens
  allele 501: 12-862-365 : polymorphic base C or T
  misc_binding 481..500: 12-862-365.mis1, potential
  misc_binding 502..521: 12-862-365.mis2, potential complement
  primer_bind 137..155: upstream amplification primer
  primer_bind 591..610: downstream amplification primer, complement
  misc_binding 489..513: 12-862-365 potential probe
caaagtgctgggattacaggcgtcagccaccgcgcccggccgcatgtgtcactttttaatgtcgtgtcacactctaaagcataacttaatggcacccataagaatgagaaaaaaaacagccatcagataaggtgttccattatgcggaaaatcacaaatgaggaagttcaccagttactttggtcaggtgtatgcacgaatcgtagataaatatttcttgctagttctcccttttttcttcaagttggagaagtggtggttaaaacagacagacgggtacacatttttttgttgttgttggttgtaaagaaaatgtgacagctttagattcctgcttttttagcgtagttacagaactccaggttatcatacgagtatcagcatccttagattcaccatttatttccctaagttgaattttcagcatttttatatagtccattctacatggtttctctctccttaaaagcaaatcttgtttgcgaatttagtatgactgcyctgtctgaggaggtttctgtttttgcaaaaaaatctttttgagcttttttaccttctgtgaaatgattaaaactggcttttgtaaatatggtagaaagattatgaagaatagaagaactaatgtagagatggaatttacatttttttttctgaatgactttctttgttctattagtacacatgtaattttcagatattttaaatgctttcaggtattttaagtgctatatatattatttcgtcagtctaattgtttagtgttattatcctgagtggttttagaaaatatttctttgttttgtgggtagaatttctccctctactgatttttttttctgtaactttacagttatgacagacataaatctgctactaattatacttggtatattttaaaaagagccattgtgtatttctataaataaacttgcacaatggtgggcctatcagaggtactgaaaaatactgttcttaactattttaatataaggtatctattt

SEQ ID NO: 357 - DNA, 1000 bp, Homo Sapiens
  allele 501: 12-862-452 : polymorphic base G or T
  misc_binding 481..500: 12-862-452.mis1, potential
  misc_binding 502..521: 12-862-452.mis2, potential complement
  primer_bind 50..68: upstream amplification primer
  primer_bind 504..523: downstream amplification primer, complement
  misc_binding 489..513: 12-862-452 potential probe
aatggcacccataagaatgagaaaaaaaacagccatcagataaggtgttccattatgcggaaaatcacaaatgaggaagttcaccagttactttggtcaggtgtatgcacgaatcgtagataaatatttcttgctagttctcccttttttcttcaagttggagaagtggtggttaaaacagacagacgggtacacatttttttgttgttgttggttgtaaagaaaatgtgacagctttagattcctgcttttttagcgtagttacagaactccaggttatcatacgagtatcagcatccttagattcaccatttatttccctaagttgaattttcagcatttttatatagtccattctacatggtttctctctccttaaaagcaaatcttgtttgcgaatttagtatgactgctctgtctgaggaggtttctgtttttgcaaaaaaatctttttgagcttttttaccttctgtgaaatgattaaaactggcttttgtaaakatggtagaaagattatgaagaatagaagaactaatgtagagatggaatttacatttttttttctgaatgactttctttgttctattagtacacatgtaattttcagatattttaaatgctttcaggtattttaagtgctatatatattatttcgtcagtctaattgtttagtgttattatcctgagtggttttagaaaatatttctttgttttgtgggtagaatttctccctctactgatttttttttctgtaactttacagttatgacagacataaatctgctactaattatacttggtatattttaaaaagagccattgtgtatttctataaataaacttgcacaatggtgggcctatcagaggtactgaaaaatactgttcttaactattttaatataaggtatctatttttaagcacacaggatttctcacaatgttaaacaaaatgccatttctttaaaagcagagactgctctcacatggtcacaatcctttg

SEQ ID NO: 358 - DNA, 1001 bp, Homo Sapiens
  allele 501: 12-866-423 : polymorphic base C or T
  misc_binding 482..500: 12-866-423.mis1
  misc_binding 502..521: 12-866-423.mis2, potential complement
  primer_bind 79..98: upstream amplification primer
  primer_bind 589..609: downstream amplification primer, complement
  misc_binding 489..513: 12-866-423 potential probe
aaaaatccttccttacaaagatcactgtttggtaagcagtttaattcactgtaataaaagcatctcacaatgcgaaaaaaagtggggggcgtatttggaggtaatgagaagctaactgctgtttgctatcataggagaaaatatgaatctggacagtggcagtggaaattgagaggagggaaagggatgaaggggtactaagttttctctagacctcagtccttgctatctactaaaaaaacctattcttcacatttttctctatctcacatttattattcattaatatttcagaagtaatatgttgggactaatattaatgtattaatactttgtggcaggctctgtaatagtgtttaatatgcttcacctattttaattttcacctttttttttttttttagaaaagcttactttataataaggaatctgagacccagagttgaagcaaattgcccaaggttacacagctggtcagtagcagacacaagatccaaaccyggtttgtctgaatccagtgctgacgtccttgtgcctcacctatccgccaccgccaaactgcttcctgttcttccagttgtcactatccttgactcattgcactttgacctcaatcaatcttcttatcttttcttaaaagaaaaacatgtttgctgtctaatcttttcaactattatccagtccatttctctttccatgtaaccttggtcttcagtccatgacaatatctatcttctcacagatcatttcagctgttcagtttttgtgccttctaaatttactcacactaaatattgtcctgaaaaattcaaaatatttctccatcctttattccctggtgctcacctgagtattttgcattattaactacttctttcttcttgaaagtatttctcccacaagagctgcaaacctgtgttctcccagcatgttgccatttcaccccagcagttccttttctgtcttttttgccagttccttcatcagaaacttctatgttc

SEQ ID NO: 359 - DNA, 1001 bp, Homo Sapiens
  allele 501: 12-867-47 : polymorphic base C or T
  misc_binding 481..500: 12-867-47.mis1, potential
  misc_binding 502..521: 12-867-47.mis2, potential complement
  primer_bind 455..474: upstream amplification primer
  primer_bind 898..918: downstream amplification primer, complement
  misc_binding 489..513: 12-867-47 potential probe
agttgaagcaaattgcccaaggttacacagctggtcagtagcagacacaagatccaaacctggtttgtctgaatccagtgctgacgtccttgtgcctcacctatccgccaccgccaaactgcttcctgttcttccagttgtcactatccttgactcattgcactttgacctcaatcaatcttcttatcttttcttaaaagaaaaacatgtttgctgtctaatcttttcaactattatccagtccatttctctttccatgtaaccttggtcttcagtccatgacaatatctatcttctcacagatcatttcagctgttcagtttttgtgccttctaaatttactcacactaaatattgtcctgaaaaattcaaaatatttctccatcctttattccctggtgctcacctgagtattttgcattattaactacttctttcttcttgaaagtatttctcccacaagagctgcaaacctgtgttctcccagcatgttgccatttyaccccagcagttccttttctgtcttttttgccagttccttcatcagaaacttctatgttctgtgcatgccattagaggagctgaagttttgtttggttccttgttttctttttgtcttctactattattccctttcaatatgacccctcaatttactcttcatattacaattttaattatcatcctagagtacaaatatctattttcctgttttaatttctcaagattttgtcaagacctaatttcaaattaatgttaaagacatttgcttagcggcttaccaacaacgcgacaagacacattttacacagtctcctcatacactccttccctgctgagccagccacctttcccagtaaagaaggtaaagaagatataaaaatgattcattctgctgttagtgtcagtcttttgctcaactcccatttcccccaagtatttagattttttttttctttaagaaaataaattccagctgggcatagtggctcatgcctgta

SEQ ID NO: 360 - DNA, 1001 bp, Homo Sapiens
  allele 501: 12-868-181 : polymorphic base A or G
  misc_binding 481..500: 12-868-181.mis1, potential
  misc_binding 502..521: 12-868-181.mis2, potential complement
  primer_bind 322..340: upstream amplification primer
  primer_bind 789..809: downstream amplification primer, complement
  misc_binding 489..513: 12-868-181 potential probe
cagtaaagaaggtaaagaagatataaaaatgattcattctgctgttagtgtcagtcttttgctcaactcccatttcccccaagtatttagattttttttttctttaagaaaataaattccagctgggcatagtggctcatgcctgtaatcttagcactctttgggagtccaaggtgggagggtcgcttgagccctggagattgaggttgcagcgagctgggattatgccactgcattctagccaaacagacagagcgagatcttgtctcaagattaaaaaaaaaaaaaaaaaaaaaagccaaccacttacgtttacagaattaaaattgcagcctgccgctgacaacctgagaaaaagagacaaagtcagtggaatagcccttgttatttatgcaagtccgcatacagctagccctggagttcctggagagcaaggaacctctgtcccaaacttgactcagagcttccaaagttggtgtatttcaacaagtaagcattccrttgagccaacaatttggtaggctaccagcggctctggagcgcctgttgatgatgacagtttttgtgggggcatctcaatatgacacacaattgacactgaccagaaacacagcgccaaggacactctagtcctagccatgaaatgttatgattccaggttttcaggacagagcagagtccacttctcatctccagtatccgtaaaaatttgtccaaaatgtaactaagaaaacacaatgatattagttacttctgctccccgtcaccctcaaccccactgattacgagatgggaactcacacaaaactttgagacaaaagagcaacgagtttgctttattgtttgcttgttttgttccggagtcggggccgggagcgagtgcaggaggagggatccaagcttccaagcctctgctccgctctccttctatccagttggtctttagggcactgaaggaaactcttcttcagaaataaccttttaacttttcttctgtcagc

SEQ ID NO: 361 - DNA, 1001 bp, Homo Sapiens
  allele 501: 12-868-198 : polymorphic base A or G
  misc_binding 481..500: 12-868-198.mis1, potential
  misc_binding 502..521: 12-868-198.mis2, potential complement
  primer_bind 305..323: upstream amplification primer
  primer_bind 772..792: downstream amplification primer, complement
  misc_binding 489..513: 12-868-198 potential probe
aagatataaaaatgattcattctgctgttagtgtcagtcttttgctcaactcccatttcccccaagtatttagattttttttttctttaagaaaataaattccagctgggcatagtggctcatgcctgtaatcttagcactctttgggagtccaaggtgggagggtcgcttgagccctggagattgaggttgcagcgagctgggattatgccactgcattctagccaaacagacagagcgagatcttgtctcaagattaaaaaaaaaaaaaaaaaaaaaagccaaccacttacgtttacagaattaaaattgcagcctgccgctgacaacctgagaaaaagagacaaagtcagtggaatagcccttgttatttatgcaagtccgcatacagctagccctggagttcctggagagcaaggaacctctgtcccaaacttgactcagagcttccaaagttggtgtatttcaacaagtaagcattccgttgagccaacaatttgrtaggctaccagcggctctggagcgcctgttgatgatgacagtttttgtgggggcatctcaatatgacacacaattgacactgaccagaaacacagcgccaaggacactctagtcctagccatgaaatgttatgattccaggttttcaggacagagcagagtccacttctcatctccagtatccgtaaaaatttgtccaaaatgtaactaagaaaacacaatgatattagttacttctgctccccgtcaccctcaaccccactgattacgagatgggaactcacacaaaactttgagacaaaagagcaacgagtttgctttattgtttgcttgttttgttccggagtcggggccgggagcgagtgcaggaggagggatccaagcttccaagcctctgctccgctctccttctatccagttggtctttagggcactgaaggaaactcttcttcagaaataaccttttaacttttcttctgtcagctgcctgccaatcacgga

SEQ ID NO: 362 - DNA, 1001 bp, Homo Sapiens
  allele 501: 12-868-282 : polymorphic base C or T
  misc_binding 481..500: 12-868-282.mis1, potential
  misc_binding 502..521: 12-868-282.mis2, potential complement
  primer_bind 221..239: upstream amplification primer
  primer_bind 688..708: downstream amplification primer, complement
  misc_binding 489..513: 12-868-282 potential probe
ctttaagaaaataaattccagctgggcatagtggctcatgcctgtaatcttagcactctttgggagtccaaggtgggagggtcgcttgagccctggagattgaggttgcagcgagctgggattatgccactgcattctagccaaacagacagagcgagatcttgtctcaagattaaaaaaaaaaaaaaaaaaaaaagccaaccacttacgtttacagaattaaaattgcagcctgccgctgacaacctgagaaaaagagacaaagtcagtggaatagcccttgttatttatgcaagtccgcatacagctagccctggagttcctggagagcaaggaacctctgtcccaaacttgactcagagcttccaaagttggtgtatttcaacaagtaagcattccgttgagccaacaatttggtaggctaccagcggctctggagcgcctgttgatgatgacagtttttgtgggggcatctcaatatgacacacaattgacactgaycagaaacacagcgccaaggacactctagtcctagccatgaaatgttatgattccaggttttcaggacagagcagagtccacttctcatctccagtatccgtaaaaatttgtccaaaatgtaactaagaaaacacaatgatattagttacttctgctccccgtcaccctcaaccccactgattacgagatgggaactcacacaaaactttgagacaaaagagcaacgagtttgctttattgtttgcttgttttgttccggagtcggggccgggagcgagtgcaggaggagggatccaagcttccaagcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagg

SEQ ID NO: 363 - DNA, 1001 bp, Homo Sapiens
  allele 501: 12-869-128 : polymorphic base A or C
  misc_binding 481..500: 12-869-128.mis1, potential
  misc_binding 502..521: 12-869-128.mis2, potential complement
  primer_bind 374..394: upstream amplification primer
  primer_bind 813..833: downstream amplification primer, complement
  misc_binding 489..513: 12-869-128 potential probe
ggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtaagcccggcgcccagccgcggaaatttctctgcccacacactccgagactcgccccgccgcccgaggtgcactggcggagacaagggaggccgcgcccggcgtgcccactttgccacttccaaaatttgctgaagctgaggctgtgagcacacctcagaagtggctgggagggaacccaaacctaattgccaaatttcaggtccaggaggggagcctcttgtgtgtttattgtttgtccgtctatttmgtgactgcgcaggcccgcgattcctctcctcttgtctataggtagcgctggtggattggaatcttgaagcaggtgtacagtgtaaagctgccctggatgagcaatttgaacctcagaagactctgttcatccagtgcgatgtggctgaccagcaacaactgagaggtaagacaggggaatcaatctgtcaactgggaacgtgctctcaacaagcaacaacctgaaggcagcccggccagggggccctgggtgccgcctccgctgcctcctcgagagcagctaccttgaagctccaaaagacagtttggactgatacgtttccttctgacagcccaatagctgtaaaaccgaaagaaaggcaagactgctggagaaatccttttattgtagtcatttggcagcattaatgtaatcaaaattcctttatgtattcaaagacagtgctgctgcagtaattattaaatgattgaaattgcagacaaaacttggaaaattaaagt

SEQ ID NO: 364 - DNA, 1001 bp, Homo Sapiens
  allele 501: 12-870-491 : polymorphic base A or G
  misc_binding 481..500: 12-870-491.mis1, potential
  misc_binding 502..521: 12-870-491.mis2, potential complement
  primer_bind 11..31: upstream amplification primer
  primer_bind 528..548: downstream amplification primer, complement
  misc_binding 489..513: 12-870-491 potential probe
attattaaatgattgaaattgcagacaaaacttggaaaattaaagtaggttaagtaaggtactgttgacaaacaacttctcccagaaagctggagtccaatgacaatcaaatgtggcagtgtttttcgtttaaacatatcagaatacaagttcaaggagcatcatcacagaagtgctagatgcttttgaccatatgttttctccggctttttccccaatgagacagtactttaaaataataataatagtaatcataataaagtatacaatgttagaattgtagtagaaacatctctatcagcctttcctcaatgctttcctgtttccggctactcacttaaaatagaccaatctacttgtgaagtatcagggacaatattggcatacacaataaacagctttgattataaagctgttttttttttttttgtacatctattggagaacttgagagtgccccaataaacttacaggaaacaaaaattctggagaaaaactagraaagtaaaatatttgtatttcacaaagttttattcaaagagactgagtaaattgtaaggcactttttaatcaaggggtctgaaaacttttgcaaatcttattccagtgctcctgttcttaaagggacatcaaatgtacatttattttaaaattttaaaatattctgtaagagaatgaaaatgaactgacgtgttagaaggaagtggtgtaccaacagttaagagaaattgtaaaggaaattacgtaactgaaatctgaaaatgctaataaagacctataacacagatgacaagcatgagcagaacagatttgtaaacacaatgcaagaggaacatattgtaccagaggacaattatgttgattgcacatgatattttggatcaaggatagagccaggtcagatctcaacattcatgctgatggcataaggaacagtataaacaatctgaaagccatttctgtctcaatttatatagtttcataaatgacatttaactaca

SEQ ID NO: 365 - DNA, 1001 bp, Homo Sapiens
  allele 501: 12-872-52 : polymorphic base A or G
  misc_binding 481..500: 12-872-52.mis1, potential
  misc_binding 502..521: 12-872-52.mis2, potential complement
  primer_bind 450..470: upstream amplification primer
  primer_bind 893..911: downstream amplification primer, complement
  misc_binding 489..513: 12-872-52 potential probe
agttaaggcaaggaccggccattttcacttcttttgtggtggaatgtcatcagttaaggcaggaacaggccatttaagtatcactacttttgtgattcttcagttacttcaggccatgtggatgtatatgtgcaggtcacaggggatataatggcttagcttgggctcagaggcctgacagagatcatcctggctaacacggtgaaaccccgtctctactaaaaatacaaaaaattagccgggcgtggtggtgggcgcctgtagtcccagctactctggaggctgaggcaggagaatggcgtgaacccgggaggtggagcttgcagtgagctgagatcaggccactgcactccagcctgggggacagaacgaggctccgactcaaaaaaaaaaaaatccatgaaaaataaacagtttgtgtttgttgttcttccattcccgtacagtgagtgtaaaaggtacatattaggaaatcttgaaaatgtttttagtaaacaactrgcatagtaatttatctatatggcaactgattaatccatgtcttccccaatatgtctggtggttgttaatgattatatgaatttatttcaatcaaaataaagcttatgctgacctactttttttaaggacttgatatgttggtctggacacctgagaatatatttccgtcatgtagaaaaacaaccacaatttttatccatagtgtaaaataatagaagtagaatgaatgatcaaaggcccagggaaacagtttaaatcaattagaactctgtcaaaggctgctttgagaaacaatagacatgtgattggacagtgtaatgaaagacattcaggcctcagaatccatgccaactttatcctgtttgaacatagttttatacaaactagtaatcctagtaatctgaagtagtaataatagtgagaaagaagaaggaaatagtaaacatcgaagtttcagtaatcaaataaaatcaactgaatgaaaagtagacttttactaa

SEQ ID NO: 366 - DNA, 1001 bp, Homo Sapiens
  allele 501: 12-872-293 : polymorphic base A or G
  misc_binding 481..500: 12-872-293.mis1, potential
  misc_binding 502..521: 12-872-293.mis2, potential complement
  primer_bind 209..229: upstream amplification primer
  primer_bind 652..670: downstream amplification primer, complement
  misc_binding 489..513: 12-872-293 potential probe
ggcgtggtggtgggcgcctgtagtcccagctactctggaggctgaggcaggagaatggcgtgaacccgggaggtggagcttgcagtgagctgagatcaggccactgcactccagcctgggggacagaacgaggctccgactcaaaaaaaaaaaaatccatgaaaaataaacagtttgtgtttgttgttcttccattcccgtacagtgagtgtaaaaggtacatattaggaaatcttgaaaatgtttttagtaaacaactagcatagtaatttatctatatggcaactgattaatccatgtcttccccaatatgtctggtggttgttaatgattatatgaatttatttcaatcaaaataaagcttatgctgacctactttttttaaggacttgatatgttggtctggacacctgagaatatatttccgtcatgtagaaaaacaaccacaatttttatccatagtgtaaaataatagaagtagaatgaatgatcaaaggcccrgggaaacagtttaaatcaattagaactctgtcaaaggctgctttgagaaacaatagacatgtgattggacagtgtaatgaaagacattcaggcctcagaatccatgccaactttatcctgtttgaacatagttttatacaaactagtaatcctagtaatctgaagtagtaataatagtgagaaagaagaaggaaatagtaaacatcgaagtttcagtaatcaaataaaatcaactgaatgaaaagtagacttttactaagatataaaaactcccccaaacatgcataatagatctgaatacacaagaatatttgtattaacataacactttatgaatttaatatggcttatggaaaaggatgtttaccaatagtctaagctacagagcttcagtagcttctcagggactaagagacattgcttgctctaactgacttcaatgagctcttagcttaggatcttagctcagttctctaaaatgtaccccattaagttactgc

SEQ ID NO: 367 - DNA, 1001 bp, Homo Sapiens
  allele 501: 12-873-185 : polymorphic base T or C
  misc_binding 481..500: 12-873-185.mis1, potential
  misc_binding 502..521: 12-873-185.mis2, potential complement
  primer_bind 667..685: upstream amplification primer, complement
  primer_bind 151..169: downstream amplification primer
  misc_binding 489..513: 12-873-185 potential probe
tatcaaattctacactttaaatatgggcagtgtattgggtgtcaattatacttcaataaagccattaaacgaaataggtagcacccaaagaaagctctccaaattatttttgaaaggttggggagagaaaaaagtcataataaaataatactacttctatattcctgtgggtgatgtaggggaaaatatagattaaaaataagaattatcattttaccaggcaagagacttctcccctttttccttttatttcaaaattcctttctctgtccttttcaaatgtatataaatcttgataatggcgaaataaacctctgccagtctcacaattcaggaatgtttcctcaagtacctgtaagccttttttaaaaaattgcttaccagtttattataaaggatattacaaaggatacaggtacatagggcaaggtatgggggaaggggtgtggagcttccacatcctccctgggtggtcaaccctccaggaccctccacatgttyagccatccagaaacttttgaatcctgttctcttgtgccttttaggaagacttcatcgggtaggcatctttttgaaaggcaaacataaagagagatagtggccctatctttcagttagtgtgggaggaaaagagcttaacatctgtgggcatcttgttccaatttgcaatgagaagttcgttactcctcctgatacagccacagggagtctccccaattatcatgataaaattaagataaaagaatgtgacaaaaggtattgcaaagtcctcttacttgaggactaatgattgtctgtcttgagcgcatgtatgtaataagtctatctgcttagacctatagggggtgaaattcctttctgtcttttcaatgtgattagcatgacatcctggtttcatgctttttaaaataataaaactggcttatttctctactatgtttgttgagaagtgttctgggttggggaaagatttagtttctaattatatttccccaacagtg

SEQ ID NO: 368 - DNA, 1001 bp, Homo Sapiens
  allele 501: 12-873-319 : polymorphic base T or A
  misc_binding 481..500: 12-873-319.mis1, potential
  misc_binding 502..521: 12-873-319.mis2, potential complement
  primer_bind 801..819: upstream amplification primer, complement
  primer_bind 285..303: downstream amplification primer
  misc_binding 489..513: 12-873-319 potential probe
aatatgagatttgggcgggagcacacattcagcctgtatcatcaaatgtgggggaaaaaatgcattagtaagggtggggggactagtctcatccctcttttctctcaattcacaagtgtatgcatatgtcaaaatatcaaattctacactttaaatatgggcagtgtattgggtgtcaattatacttcaataaagccattaaacgaaataggtagcacccaaagaaagctctccaaattatttttgaaaggttggggagagaaaaaagtcataataaaataatactacttctatattcctgtgggtgatgtaggggaaaatatagattaaaaataagaattatcattttaccaggcaagagacttctcccctttttccttttatttcaaaattcctttctctgtccttttcaaatgtatataaatcttgataatggcgaaataaacctctgccagtctcacaattcaggaatgtttcctcaagtacctgtaagcctttttwaaaaaattgcttaccagtttattataaaggatattacaaaggatacaggtacatagggcaaggtatgggggaaggggtgtggagcttccacatcctccctgggtggtcaaccctccaggaccctccacatgttcagccatccagaaacttttgaatcctgttctcttgtgccttttaggaagacttcatcgggtaggcatctttttgaaaggcaaacataaagagagatagtggccctatctttcagttagtgtgggaggaaaagagcttaacatctgtgggcatcttgttccaatttgcaatgagaagttcgttactcctcctgatacagccacagggagtctccccaattatcatgataaaattaagataaaagaatgtgacaaaaggtattgcaaagtcctcttacttgaggactaatgattgtctgtcttgagcgcatgtatgtaataagtctatctgcttagacctatagggggtgaaattcctttctgtctttt

SEQ ID NO: 369 - DNA, 1001 bp, Homo Sapiens
  allele 501: 12-875-248 : polymorphic base T or C
  misc_binding 502..521: 12-875-248.mis1, potential complement
  misc_binding 482..500: 12-875-248.mis2
  primer_bind 727..747: upstream amplification primer, complement
  primer_bind 251..271: downstream amplification primer
  misc_binding 489..513: 12-875-248 potential probe
tggatctgtgaacctccagctgagtgtctgtaaggaggatgagaaatagtgagataaacagatggggaataaggaaggagatgttttcttctttcctttattcctatctgaactgcctacaaaaaaacagatgaggccaattcccaaagtgtcttttctttaaaagaagttttgtaatggtgctatattctctccacacagtgaaactgtgcaaaaactgaattttccttcactgtgggtcaccgggaacatacctggtcttatctcattgtcaagccaatcagtttctattgttatcgttacttagagcttcccctcctggacagtttctgtgcttctgagcagaggaagaccttgatttctaggcaagacactgagatgcctattcttggaaaattatgctaatgttttctttctttcttctttcctttcttccctctgcctccctttctgtctctctccttcttcctctcctggtcttggtctttgtctctacctctytctctctctctcctactctttgtaaaacagactattgcctctaattccacaagatacttaggttacttgcacagttacagataaaactcatagggcttatcagtaggaatttttctaacaataacttgtgcagttactcatacagcatatcatatgctcccactgttgcagattcaaaaagttgacagaaattagggaaatttaattccagagcagagtgccagtgagccaggatagttacacaaaagtaagtttcaaaagacaatttcagtgtcaggattcaattgaaaaggctgataacttcagttttcttcatatgtccagatatatttaacaacaaaattctaaaaacttttttgttttaaaagggaggagtgttctaactctcagaaccaaaaatatattcactgattaaagttttgttgaccttagttcataaaggatattaaatttaaaaaatcctaagaatttatgaaatgtggaaaaaaaacatattaaga

SEQ ID NO: 370 - DNA, 1001 bp, Homo Sapiens
  allele 501: 12-876-265 : polymorphic base T or A
  misc_binding 481..500: 12-876-265.mis1, potential
  misc_binding 502..521: 12-876-265.mis2, potential complement
  primer_bind 745..765: upstream amplification primer, complement
  primer_bind 242..261: downstream amplification primer
  misc_binding 489..513: 12-876-265 potential probe
tagtactgggctatgtacttcacatacatcttaatatttaaccgtcatgagaacattctataaaaaccattattgctgtcttaacttttgtacaactgatctgaaaaagattaagaaacacctctggttacaaatggtaagctggtatccatgtttcctgctttatttaggaagagctttccttcccattcttcattctaaaactcagtgcagaaagtctcgttacttagcaccacctagacatacagttacattatgtccaagatcttatttctagtataaaaattctaaaatttgcttaaatattgcaagtatttcttctagaaatattattaattccaccacaagtcagaatatggtggtagtggataatgagcctaagaaaatttggcagattctcaaacgtatagcagaataatactgtgacaaggcatagggtggcatcatattggtcagatctgacatttacttacagagtgaagttggaacaatttaccaaawatctctaagcttcaggttcttcttctgtagactggaagaaataatagatccaacctcatggcatcattttaggaaataaatgagataatgtgtataaacctctaggtataattcctgttgcagagtaagcctttaaaaactgctaactatcatcatcgtcatcgtcaccactatcattattttgaagactctaggagacgaatatacatctgtttaattatatcaagccacagtaaccctgagcatcataatacatacctcttcctagactaatgtgagatttctgggtaactttcagtacctacaaatcttgttatttttctcttcacaaagacagctatattcagtacaaaatgtactccctgggaacacttgctctagctcctaagtataaaccaatcaataacaactgtgtgacataagagaagatacttaatcataattgttttaatctacttatctgtaaaataaagggattgaaacagaccataaaaagcaaa

SEQ ID NO: 371 - DNA, 1001 bp, Homo Sapiens
  allele 501: 12-876-280 : polymorphic base C or G
  misc_binding 481..500: 12-876-280.mis1, potential
  misc_binding 502..521: 12-876-280.mis2, potential complement
  primer_bind 760..780: upstream amplification primer, complement
  primer_bind 257..276: downstream amplification primer
  misc_binding 489..513: 12-876-280 potential probe
gacgccagatctttctagtactgggctatgtacttcacatacatcttaatatttaaccgtcatgagaacattctataaaaaccattattgctgtcttaacttttgtacaactgatctgaaaaagattaagaaacacctctggttacaaatggtaagctggtatccatgtttcctgctttatttaggaagagctttccttcccattcttcattctaaaactcagtgcagaaagtctcgttacttagcaccacctagacatacagttacattatgtccaagatcttatttctagtataaaaattctaaaatttgcttaaatattgcaagtatttcttctagaaatattattaattccaccacaagtcagaatatggtggtagtggataatgagcctaagaaaatttggcagattctcaaacgtatagcagaataatactgtgacaaggcatagggtggcatcatattggtcagatctgacatttacttacagagtgaagttgsaacaatttaccaaatatctctaagcttcaggttcttcttctgtagactggaagaaataatagatccaacctcatggcatcattttaggaaataaatgagataatgtgtataaacctctaggtataattcctgttgcagagtaagcctttaaaaactgctaactatcatcatcgtcatcgtcaccactatcattattttgaagactctaggagacgaatatacatctgtttaattatatcaagccacagtaaccctgagcatcataatacatacctcttcctagactaatgtgagatttctgggtaactttcagtacctacaaatcttgttatttttctcttcacaaagacagctatattcagtacaaaatgtactccctgggaacacttgctctagctcctaagtataaaccaatcaataacaactgtgtgacataagagaagatacttaatcataattgttttaatctacttatctgtaaaataaagggattgaaacag

SEQ ID NO: 372 - DNA, 1001 bp, Homo Sapiens
  allele 501: 12-876-454 : polymorphic base G or A
  misc_binding 481..500: 12-876-454.mis1, potential
  misc_binding 502..521: 12-876-454.mis2, potential complement
  primer_bind 934..954: upstream amplification primer, complement
  primer_bind 431..450: downstream amplification primer
  misc_binding 489..513: 12-876-454 potential probe
ttttctacctccttcaactagaaagtgagcaccatgaagataaaaatagtactgtccccttagggcctattactggcccaatcacatactagatatcaaatagatatctgttgaatacagtactgatattccaaacattaactggtacagcacaggcaataaataatcagaagagacgccagatctttctagtactgggctatgtacttcacatacatcttaatatttaaccgtcatgagaacattctataaaaaccattattgctgtcttaacttttgtacaactgatctgaaaaagattaagaaacacctctggttacaaatggtaagctggtatccatgtttcctgctttatttaggaagagctttccttcccattcttcattctaaaactcagtgcagaaagtctcgttacttagcaccacctagacatacagttacattatgtccaagatcttatttctagtataaaaattctaaaatttgcttaaatattgcaartatttcttctagaaatattattaattccaccacaagtcagaatatggtggtagtggataatgagcctaagaaaatttggcagattctcaaacgtatagcagaataatactgtgacaaggcatagggtggcatcatattggtcagatctgacatttacttacagagtgaagttggaacaatttaccaaatatctctaagcttcaggttcttcttctgtagactggaagaaataatagatccaacctcatggcatcattttaggaaataaatgagataatgtgtataaacctctaggtataattcctgttgcagagtaagcctttaaaaactgctaactatcatcatcgtcatcgtcaccactatcattattttgaagactctaggagacgaatatacatctgtttaattatatcaagccacagtaaccctgagcatcataatacatacctcttcctagactaatgtgagatttctgggtaactttcagtacctacaaatct

SEQ ID NO: 373 - DNA, 1001 bp, Homo Sapiens
  allele 501: 12-877-59 : polymorphic base C or T
  misc_binding 481..500: 12-877-59.mis1, potential
  misc_binding 502..521: 12-877-59.mis2, potential complement
  primer_bind 443..462: upstream amplification primer
  primer_bind 875..895: downstream amplification primer, complement
  misc_binding 489..513: 12-877-59 potential probe
tgcctcatatcatttgactttgtgtccccacccaaatctcatctcaaattgcaatccccatgtgtcaagggagagatctggtaggaggttattggatcatgatggaggtttcccccatttcccccatgctgttcccccaatagtgagtgagttctcacaagatctgatggttttataaggggtcttccccctttgcttgcccctctctctcacctgctgccatgtaagatgtgcctcttcctcttctgccatgattgtaagtttcctgagacctccccagccatatggaactgtgagtcaattaaacctttcctttataaattaaccatctcaagtatttataggagtgtgagaacatactaatacaatgctattggattgatgctattatagaaaaggaaaagaaactgaaaataacataaaaatcaagcagataaattgtgaagtagtattccaatgaagaggaaaagaactagattttgaagtaaaaatagaaagatytatagttacggcaaagaagcgacattgttagcatgatctggaagcaagcaaaagggaagtagtcatgggtgtgttaacagtaattaaaggaatttacactttatacttttaggtaaagtaaaatgtctcctactcacagggaagaagatagtttagtgacggggaggttagaagagagtggaaatgcttgaatttgctacagtaggtcatgagagtgaagagggccacatttatttttgtagtttattatttgctctcataactccctaatagcatgaacttgaaaatacacaagttagatagattcatccatgtggatacaacagtaacatcatgacattgacattattgacaagaaagtgatgcaaataaagggttgtgaaatctggaaaagaatgaatagagaaaagtcaagagagggctgacagagaagaagtagaattgccaaagatctacagatctaaactttaagagcctcaaaaagattacaataatgtatt

SEQ ID NO: 374 - DNA, 1001 bp, Homo Sapiens
  allele 501: 12-877-69 : polymorphic base G or T
  misc_binding 481..500: 12-877-69.mis1, potential
  misc_binding 502..521: 12-877-69.mis2, potential complement
  primer_bind 433..452: upstream amplification primer
  primer_bind 865..885: downstream amplification primer, complement
  misc_binding 489..513: 12-877-69 potential probe
catttgactttgtgtccccacccaaatctcatctcaaattgcaatccccatgtgtcaagggagagatctggtaggaggttattggatcatgatggaggtttcccccatttcccccatgctgttcccccaatagtgagtgagttctcacaagatctgatggttttataaggggtcttccccctttgcttgcccctctctctcacctgctgccatgtaagatgtgcctcttcctcttctgccatgattgtaagtttcctgagacctccccagccatatggaactgtgagtcaattaaacctttcctttataaattaaccatctcaagtatttataggagtgtgagaacatactaatacaatgctattggattgatgctattatagaaaaggaaaagaaactgaaaataacataaaaatcaagcagataaattgtgaagtagtattccaatgaagaggaaaagaactagattttgaagtaaaaatagaaagatctatagttackgcaaagaagcgacattgttagcatgatctggaagcaagcaaaagggaagtagtcatgggtgtgttaacagtaattaaaggaatttacactttatacttttaggtaaagtaaaatgtctcctactcacagggaagaagatagtttagtgacggggaggttagaagagagtggaaatgcttgaatttgctacagtaggtcatgagagtgaagagggccacatttatttttgtagtttattatttgctctcataactccctaatagcatgaacttgaaaatacacaagttagatagattcatccatgtggatacaacagtaacatcatgacattgacattattgacaagaaagtgatgcaaataaagggttgtgaaatctggaaaagaatgaatagagaaaagtcaagagagggctgacagagaagaagtagaattgccaaagatctacagatctaaactttaagagcctcaaaaagattacaataatgtattttcaatgatg

SEQ ID NO: 375 - DNA, 1001 bp, Homo Sapiens
  allele 501: 12-877-79 : polymorphic base C or T
  misc_binding 481..500: 12-877-79.mis1, potential
  misc_binding 502..521: 12-877-79.mis2, potential complement
  primer_bind 423..442: upstream amplification primer
  primer_bind 855..875: downstream amplification primer, complement
  misc_binding 489..513: 12-877-79 potential probe
tgtgtccccacccaaatctcatctcaaattgcaatccccatgtgtcaagggagagatctggtaggaggttattggatcatgatggaggtttcccccatttcccccatgctgttcccccaatagtgagtgagttctcacaagatctgatggttttataaggggtcttccccctttgcttgcccctctctctcacctgctgccatgtaagatgtgcctcttcctcttctgccatgattgtaagtttcctgagacctccccagccatatggaactgtgagtcaattaaacctttcctttataaattaaccatctcaagtatttataggagtgtgagaacatactaatacaatgctattggattgatgctattatagaaaaggaaaagaaactgaaaataacataaaaatcaagcagataaattgtgaagtagtattccaatgaagaggaaaagaactagattttgaagtaaaaatagaaagatctatagttacggcaaagaagygacattgttagcatgatctggaagcaagcaaaagggaagtagtcatgggtgtgttaacagtaattaaaggaatttacactttatacttttaggtaaagtaaaatgtctcctactcacagggaagaagatagtttagtgacggggaggttagaagagagtggaaatgcttgaatttgctacagtaggtcatgagagtgaagagggccacatttatttttgtagtttattatttgctctcataactccctaatagcatgaacttgaaaatacacaagttagatagattcatccatgtggatacaacagtaacatcatgacattgacattattgacaagaaagtgatgcaaataaagggttgtgaaatctggaaaagaatgaatagagaaaagtcaagagagggctgacagagaagaagtagaattgccaaagatctacagatctaaactttaagagcctcaaaaagattacaataatgtattttcaatgatgaatgtccaac

SEQ ID NO: 376 - DNA, 1001 bp, Homo Sapiens
  allele 501: 12-878-153 : polymorphic base C or T
  misc_binding 481..500: 12-878-153.mis1, potential
  misc_binding 502..521: 12-878-153.mis2, potential complement
  primer_bind 349..369: upstream amplification primer
  primer_bind 839..859: downstream amplification primer, complement
  misc_binding 489..513: 12-878-153 potential probe
tcctgcctcagtcttctgagtagctgggactacaggcgcccgccaccacactcgcctaattttttgtatttttagtagagatggggtttcaccgtgttagccaggatggtctcgatctcctgacctcgtgatccgcctgcctcggcctcccaaagtgctaggattacaggcatgagccactgctcccggcctacaataactttttaactggtattcctttgtccactcttgccatttacacccattcttccacagcagccagagtgattatttcaaaatcacactaaggcatatcatgccatttccttgcttagtaacttcccagcataaaatccctatgctagttaactgataacctattttaggaactacgtcttcttatctcctgtaatagtctctttcttttactatcatgggtatgaattttcaaacttaaaaataaacttgattttcaaaagggacaaaattttggtcaatatgtaatttgtactgcaatactcycaagaacatttttttaaaaaatgggaataaagagaatttaagactatgttcacatctaaatgttgtccaaaagcacttattcaacactcctaataaaccagagtacagaggccagttcaggagtcttaattgacaatcagcttatgtaattcttttctctaaaagatttccattttactattgtacttttttatcttttaaggcacaggtaggctagatttctttcaaagtgaaagtcgatttaaacctttaaaagtttgttttagttcttcagatttttttgtttctttaaacaccaccatgtggtcatggctgactaggttaggctgaatgaaaacagtgtggtgaaatatcattaattttgcggtcagaagacaggttcaaacccaaaatacatttattaattttaggaacttgggcaatttaattaagctttgtgagcctcagtttccacattaacatattatatgggcataataataataataataataatgact

SEQ ID NO: 377 - DNA, 1001 bp, Homo Sapiens
  allele 501: 12-878-419 : polymorphic base G or T
  misc_binding 481..500: 12-878-419.mis1, potential
  misc_binding 502..521: 12-878-419.mis2, potential complement
  primer_bind 83..103: upstream amplification primer
  primer_bind 573..593: downstream amplification primer, complement
  misc_binding 489..513: 12-878-419 potential probe
attatttcaaaatcacactaaggcatatcatgccatttccttgcttagtaacttcccagcataaaatccctatgctagttaactgataacctattttaggaactacgtcttcttatctcctgtaatagtctctttcttttactatcatgggtatgaattttcaaacttaaaaataaacttgattttcaaaagggacaaaattttggtcaatatgtaatttgtactgcaatactctcaagaacatttttttaaaaaatgggaataaagagaatttaagactatgttcacatctaaatgttgtccaaaagcacttattcaacactcctaataaaccagagtacagaggccagttcaggagtcttaattgacaatcagcttatgtaattcttttctctaaaagatttccattttactattgtacttttttatcttttaaggcacaggtaggctagatttctttcaaagtgaaagtcgatttaaacctttaaaagtttgttttakttcttcagatttttttgtttctttaaacaccaccatgtggtcatggctgactaggttaggctgaatgaaaacagtgtggtgaaatatcattaattttgcggtcagaagacaggttcaaacccaaaatacatttattaattttaggaacttgggcaatttaattaagctttgtgagcctcagtttccacattaacatattatatgggcataataataataataataataatgactgcaaacaattgtgaggatttaatatataatacatgtaaatacagaaagccctacaagttaaatgccttcttcttaggtgaatcagaattaaaaacaattactctttaaattaaggaaactgtagaatttaccctctggtttttcagttccttaattatctttccaatttttattgttaaaaacaagcacacaaggtatgtaaagtgggtttattgaaataagctgttctttcatgttcatatctttgacagatctacacacttgga

SEQ ID NO: 378 - DNA, 1001 bp, Homo Sapiens
  allele 501: 12-879-67 : polymorphic base G or C
  misc_binding 481..500: 12-879-67.mis1, potential
  misc_binding 502..521: 12-879-67.mis2, potential complement
  primer_bind 435..453: upstream amplification primer
  primer_bind 951..971: downstream amplification primer, complement
  misc_binding 489..513: 12-879-67 potential probe
atgactgcaaacaattgtgaggatttaatatataatacatgtaaatacagaaagccctacaagttaaatgccttcttcttaggtgaatcagaattaaaaacaattactctttaaattaaggaaactgtagaatttaccctctggtttttcagttccttaattatctttccaatttttattgttaaaaacaagcacacaaggtatgtaaagtgggtttattgaaataagctgttctttcatgttcatatctttgacagatctacacacttggagtccttgctaggatatctctatgcctctaatctgggaattgaaaaaataaatcgcaaaaatgtacacatgttatacacgtacttcaggtgacctcaaatgtggcattataaaatttaagaattggaatggctttcagaagcaatctcttttactaataattctgcaagcaactaatattggatgcttaatatgtcagacatcatgctaaacgctttacatgtagttctscatgtattaattactccaatacttttgtatacattattttttatcttccttgtatgcatgagggaactgacactctgaaaggtgaaataacttgcttaaattcactagtaagtagcagtgccagattctgaaaccaagttgattcactagttcaaagcccatagatttacccaccacattcttataactcattaatgaaaacactcattagaaaatgggcaagagatggtcatattcactggacaccgagtctggcttaaggtgatgagtgtgggaaggtatgtggggaggccttcttcctactgcaaagaggcaagtctgagggctggcgccacccagcaatgactctgcttctacttccggaacgccaagggagacaattccggttccgggatcccccttcttggtcacctgcaagtcccagctcgctccacctacagaaagagaagccatctcagtatgatctttatgaacatagccgacctttaatgacttctgag

SEQ ID NO: 379 - DNA, 1001 bp, Homo Sapiens
  allele 501: 12-879-439 : polymorphic base A or G
  misc_binding 481..500: 12-879-439.mis1, potential
  misc_binding 502..521: 12-879-439.mis2, potential complement
  primer_bind 64..82: upstream amplification primer
  primer_bind 580..600: downstream amplification primer, complement
  misc_binding 489..513: 12-879-439 potential probe
gtggcattataaaatttaagaattggaatggctttcagaagcaatctcttttactaataattctgcaagcaactaatattggatgcttaatatgtcagacatcatgctaaacgctttacatgtagttctccatgtattaattactccaatacttttgtatacattattttttatcttccttgtatgcatgagggaactgacactctgaaaggtgaaataacttgcttaaattcactagtaagtagcagtgccagattctgaaaccaagttgattcactagttcaaagcccatagatttacccaccacattcttataactcattaatgaaaacactcattagaaaatgggcaagagatggtcatattcactggacaccgagtctggcttaaggtgatgagtgtgggaaggtatgtggggaggccttcttcctactgcaaagaggcaagtctgagggctggcgccacccagcaatgactctgcttctacttccggaacgccargggagacaattccggttccgggatcccccttcttggtcacctgcaagtcccagctcgctccacctacagaaagagaagccatctcagtatgatctttatgaacatagccgacctttaatgacttctgagaggaatggagtttccttgatgagcctgagagctgtgccccgtgatgcagagaactttgcctatataacctcgccaggttgttggtgtggagcaaagggaaagcagacaccctcagtgaagtgtttcagtagaaagtgtcacagctaggtccattcatccagaaggctcatccctgtgagatgtgtgttctggtcttaagggacattttgtatctggctgagcaacaaggaacgctatctgggcagaaatagtacacttgtgaggcatgtgggaaacaattctggtttagtgcaaacatgcaccagcaccagaaggaacacaatggaatagagacgtggacaatgctttctctgtgaaaggctgcagatttt

SEQ ID NO: 380 - DNA, 1001 bp, Homo Sapiens
  allele 501: 12-881-210 : polymorphic base A or G
  misc_binding 481..500: 12-881-210.mis1, potential
  misc_binding 502..521: 12-881-210.mis2, potential complement
  primer_bind 292..311: upstream amplification primer
  primer_bind 723..743: downstream amplification primer, complement
  misc_binding 489..513: 12-881-210 potential probe
aaaaaaacaaaaaacaaaaaccggtgtacaactgaggtactttccacatacatataaactcatgaaactgtcacaattatgctaatgtacatatccaaatatccattactcctgtatacctttctaataatctttccctactctcacttgccctccaggcaacccttgatttaccttttttcaaaataaattagttaatattttctggaattttatatgattttaattataaagtgttttttattattcttgttttcttcatgctgcataattattttaatattcattaatgttgcttatgtgaatagttcattcttttcttgcagagtcacattctgttctatggatattatcactatttgtttacccatttatctgttagtggatatttgggctgtttctggttttgggttattacaaataaaatggcatagttgaagtatacaatttgacatgcttaaactcttgaaactgaaagtttcttcctgcgcttgcaacatrtaaaattatttttacaaggacctagtctaccttttgtaatggatattttatatgtagacacaaatggagagggatgtattatgaaactctagaagcccttccccaatcttccatcattatatcatttcatagccattcttgtttcatcaggctccaccgcattactaggtgactttacgtacaattccggacatcatgtcatttaatgcataattttttcaggatgcacttctataatgtaagtgttctgtcataactctaataattctcatacaaaatgaaaatatttaaaaatattaaaaacagataagcaaatgagttgataaccaaataaaaatactataagtgatcaataagcatatgaaaaatattcaacctcactaacaataaagatatacacatttaaataaaaaaactatttatttcttttcttacccacatttggcaaagatgtaaatgagtgacagtatttgataggagggatatggtcaccttcaaat

SEQ ID NO: 381 - DNA, 1001 bp, Homo Sapiens
  allele 501: 12-881-389 : polymorphic base G or T
  misc_binding 481..500: 12-881-389.mis1, potential
  misc_binding 502..521: 12-881-389.mis2, potential complement
  primer_bind 113..132: upstream amplification primer
  primer_bind 544..564: downstream amplification primer, complement
  misc_binding 489..513: 12-881-389 potential probe
ttcaaaataaattagttaatattttctggaattttatatgattttaattataaagtgttttttattattcttgttttcttcatgctgcataattattttaatattcattaatgttgcttatgtgaatagttcattcttttcttgcagagtcacattctgttctatggatattatcactatttgtttacccatttatctgttagtggatatttgggctgtttctggttttgggttattacaaataaaatggcatagttgaagtatacaatttgacatgcttaaactcttgaaactgaaagtttcttcctgcgcttgcaacatataaaattatttttacaaggacctagtctaccttttgtaatggatattttatatgtagacacaaatggagagggatgtattatgaaactctagaagcccttccccaatcttccatcattatatcatttcatagccattcttgtttcatcaggctccaccgcattactaggtgactttacktacaattccggacatcatgtcatttaatgcataattttttcaggatgcacttctataatgtaagtgttctgtcataactctaataattctcatacaaaatgaaaatatttaaaaatattaaaaacagataagcaaatgagttgataaccaaataaaaatactataagtgatcaataagcatatgaaaaatattcaacctcactaacaataaagatatacacatttaaataaaaaaactatttatttcttttcttacccacatttggcaaagatgtaaatgagtgacagtatttgataggagggatatggtcaccttcaaattaattggtgggagtatacattggaatctcgtttttgctcttttgtttttgcttttggagtcagggtctcactctgttgccctggctggagtgcggtggtgtgatcacagctctctgcagccacgaactcctgggctcaagcagatatcctgtctcagcttcccaagtagctggaactag

SEQ ID NO: 382 - DNA, 1001 bp, Homo Sapiens
  allele 501: 12-883-273 : polymorphic base G or C
  misc_binding 481..500: 12-883-273.mis1, potential
  misc_binding 502..521: 12-883-273.mis2, potential complement
  primer_bind 229..248: upstream amplification primer
  primer_bind 674..694: downstream amplification primer, complement
  misc_binding 489..513: 12-883-273 potential probe
gggataggaattcttaaatccaaaaggaaaagtaaggtttgaaatatcaatttgatcacacaggtttttttttttctttttttttttggtagtgatttgaacaaaaacaggaaaagtgcctacacatggatataagtggcaaaacagtcaactatcaaaaggatagctgtaagcagtgattaataaaatttagttatagacattactaaagaccagatgtccagctaactgacaatcaccacttaaactggataaaacatttatgtgatttcacacaacacggagttgaggattgcttgatcttacaggtcaatgatatcatcgggcccagggttgtgtcatccctcccaccgaccattctttatgttggtttcatcttcaggatactaggaaataggggttgtccatttaagttacgacattcatataaagcaggcaatgtaaccatttcttcaggttttcttaagagcaacaaaaaatttctcagcagcatccatcctsttcccatctctagctgattgcctcccaggtctcactgaccaaaactgggtcacctgctggctctgaaaccagccactgtcaaggagaatgggatttccatgactgaattaaattaattaatcagtgtctacattaaatttggggagatcaccttcctcgtattatatggagaggaggtagatacaggagcaaaatagaacttttattagaaagaaaaaaggagaaaataaaacctctaggaaatcaagagtaagcattattctatattccaagatccaagagaattaaacagagtagttaagtgtggaatactgagacatgagaaccatatgcagagaagaagggtaaataaattttgcctccaacatttagaaaacaaaaagaatatatggaattattgaagatgttgagaattgagtgaaagtaatagacatttttggaatacaacctgtagcataaaatctcatattgggcaactaagtgaagttttgcagatatat

SEQ ID NO: 383 - DNA, 1001 bp, Homo Sapiens
  allele 501: 12-885-196 : polymorphic base T or C
  misc_binding 481..500: 12-885-196.mis1, potential
  misc_binding 502..521: 12-885-196.mis2, potential complement
  primer_bind 677..696: upstream amplification primer, complement
  primer_bind 235..255: downstream amplification primer
  misc_binding 489..513: 12-885-196 potential probe
aagactatcacatactttctaccattaaggagtttatactttttcaagtgaaagggacaaatgaacagacaattatcatacagtactattatttctactataatgggtaagtttaaggttatttgttagtagaaactgtccataaaactattgcttttattgtcagtctgaagatactgcagagtcagaatagacttgataagaagaatcatcagtaagaaaaagaaaagatgaaggaagagtgagaatatcaccatggtctctgacttgggaaagtggggatatactgccacaactcacagagatatggaatacaggagtgagacctgattccatgacagctagagatgggtagttagaggccaaaaaggcaaagtgataactataaatggaatgtaagcataagaactgatgccatgggagtaaatatacttattgagggagtgtatgtgatgtagactgtgaacataagagagcctgtgttaaagtcctagaaggaaytgacagaagtcaacaccaataggttaacagaagaggaccttgcagagaaccctaaaaaggctaaaaactggggggcaagaaacagaatgcagaagcatgaaactaaaggcaggaaaatggttcgagaagtaaagataaagagtgtcaaatgttaaagcgaagtagaaatgacaatgactacaatgtgtatgtgtgtacttggacagtgcatgatgaatattgctattatcttaagagaaaagctaaggtggtaccatttcctctccttccctccagtgcctatcatccaacatccattgatattcatcatccatttatttattcaaaaaaatttaaagggtccataatgtcctaagaagtggaatactttagaaatagaaagtaaattatttctagtggttgggatatatcaaaaagaagtgaggaaagcagtcaataaaaaacaagtgaagggaaaagaaattttaatttattgaagaatgagtggtatgtgtattagt

SEQ ID NO: 384 - DNA, 1001 bp, Homo Sapiens
  allele 501: 12-885-333 : polymorphic base C or G
  misc_binding 481..500: 12-885-333.mis1, potential
  misc_binding 502..521: 12-885-333.mis2, potential complement
  primer_bind 814..833: upstream amplification primer, complement
  primer_bind 372..392: downstream amplification primer
  misc_binding 489..513: 12-885-333 potential probe
ctcaacactattaaactcaaaaatattgaaattattacattactcaaaattaaaatttatctcaaatgtctcactgaagaaattgttttattacacactaacttccaataaatgtttgaggagcttggaatataacaaagactatcacatactttctaccattaaggagtttatactttttcaagtgaaagggacaaatgaacagacaattatcatacagtactattatttctactataatgggtaagtttaaggttatttgttagtagaaactgtccataaaactattgcttttattgtcagtctgaagatactgcagagtcagaatagacttgataagaagaatcatcagtaagaaaaagaaaagatgaaggaagagtgagaatatcaccatggtctctgacttgggaaagtggggatatactgccacaactcacagagatatggaatacaggagtgagacctgattccatgacagctagagatgggtagttagaggcsaaaaaggcaaagtgataactataaatggaatgtaagcataagaactgatgccatgggagtaaatatacttattgagggagtgtatgtgatgtagactgtgaacataagagagcctgtgttaaagtcctagaaggaactgacagaagtcaacaccaataggttaacagaagaggaccttgcagagaaccctaaaaaggctaaaaactggggggcaagaaacagaatgcagaagcatgaaactaaaggcaggaaaatggttcgagaagtaaagataaagagtgtcaaatgttaaagcgaagtagaaatgacaatgactacaatgtgtatgtgtgtacttggacagtgcatgatgaatattgctattatcttaagagaaaagctaaggtggtaccatttcctctccttccctccagtgcctatcatccaacatccattgatattcatcatccatttatttattcaaaaaaatttaaagggtccataatgtcctaagaagtgga

SEQ ID NO: 385 - DNA, 1001 bp, Homo Sapiens
  allele 501: 12-885-407 : polymorphic base T or C
  misc_binding 481..500: 12-885-407.mis1, potential
  misc_binding 502..521: 12-885-407.mis2, potential complement
  primer_bind 888..907: upstream amplification primer, complement
  primer_bind 446..466: downstream amplification primer
  misc_binding 489..513: 12-885-407 potential probe
ttatctaaactatttcctcaatcaaggtaaaactttaacatattgccccaatatataatttcagccactgtgtactcaacactattaaactcaaaaatattgaaattattacattactcaaaattaaaatttatctcaaatgtctcactgaagaaattgttttattacacactaacttccaataaatgtttgaggagcttggaatataacaaagactatcacatactttctaccattaaggagtttatactttttcaagtgaaagggacaaatgaacagacaattatcatacagtactattatttctactataatgggtaagtttaaggttatttgttagtagaaactgtccataaaactattgcttttattgtcagtctgaagatactgcagagtcagaatagacttgataagaagaatcatcagtaagaaaaagaaaagatgaaggaagagtgagaatatcaccatggtctctgacttgggaaagtggggatatactgycacaactcacagagatatggaatacaggagtgagacctgattccatgacagctagagatgggtagttagaggccaaaaaggcaaagtgataactataaatggaatgtaagcataagaactgatgccatgggagtaaatatacttattgagggagtgtatgtgatgtagactgtgaacataagagagcctgtgttaaagtcctagaaggaactgacagaagtcaacaccaataggttaacagaagaggaccttgcagagaaccctaaaaaggctaaaaactggggggcaagaaacagaatgcagaagcatgaaactaaaggcaggaaaatggttcgagaagtaaagataaagagtgtcaaatgttaaagcgaagtagaaatgacaatgactacaatgtgtatgtgtgtacttggacagtgcatgatgaatattgctattatcttaagagaaaagctaaggtggtaccatttcctctccttccctccagtgcctatcatcca

SEQ ID NO: 386 - DNA, 1001 bp, Homo Sapiens
  allele 501: 12-885-410 : polymorphic base C or G
  misc_binding 481..500: 12-885-410.mis1, potential
  misc_binding 502..521: 12-885-410.mis2, potential complement
  primer_bind 891..910: upstream amplification primer, complement
  primer_bind 449..469: downstream amplification primer
  misc_binding 489..513: 12-885-410 potential probe
atattatctaaactatttcctcaatcaaggtaaaactttaacatattgccccaatatataatttcagccactgtgtactcaacactattaaactcaaaaatattgaaattattacattactcaaaattaaaatttatctcaaatgtctcactgaagaaattgttttattacacactaacttccaataaatgtttgaggagcttggaatataacaaagactatcacatactttctaccattaaggagtttatactttttcaagtgaaagggacaaatgaacagacaattatcatacagtactattatttctactataatgggtaagtttaaggttatttgttagtagaaactgtccataaaactattgcttttattgtcagtctgaagatactgcagagtcagaatagacttgataagaagaatcatcagtaagaaaaagaaaagatgaaggaagagtgagaatatcaccatggtctctgacttgggaaagtggggatatastgccacaactcacagagatatggaatacaggagtgagacctgattccatgacagctagagatgggtagttagaggccaaaaaggcaaagtgataactataaatggaatgtaagcataagaactgatgccatgggagtaaatatacttattgagggagtgtatgtgatgtagactgtgaacataagagagcctgtgttaaagtcctagaaggaactgacagaagtcaacaccaataggttaacagaagaggaccttgcagagaaccctaaaaaggctaaaaactggggggcaagaaacagaatgcagaagcatgaaactaaaggcaggaaaatggttcgagaagtaaagataaagagtgtcaaatgttaaagcgaagtagaaatgacaatgactacaatgtgtatgtgtgtacttggacagtgcatgatgaatattgctattatcttaagagaaaagctaaggtggtaccatttcctctccttccctccagtgcctatcat

SEQ ID NO: 387 - DNA, 1001 bp, Homo Sapiens
  allele 501: 12-886-195 : polymorphic base T or C
  misc_binding 502..521: 12-886-195.mis1, potential complement
  misc_binding 482..500: 12-886-195.mis2
  primer_bind 674..694: upstream amplification primer, complement
  primer_bind 246..266: downstream amplification primer
  misc_binding 489..513: 12-886-195 potential probe
aggctaatagaattttatagtatcattcatcctaaaacattgttgtaagctttgcttttcgtatatatttaaggattaaaaaaaaaacaatactaaagcaaggcttctcgtgattagtgtatacactgtggaatagcagatgttacaatgtaccctgaggacaaaagaggctgccaaatttgaacacatcagttttaacaaccctgaaactcatttttgccaaatgttttaagtacaggaaataacttgagccacactgtattttcttttttatttaaaacatgactaaaggttgagtctttcagaagagctgaggcaaatagccaattaaagctatgtccatgatttgcaaacttctttgtgagatgattatgcacaataacccaacttcagctacctaaagtgacaggttaatgataagacccctcatgttttcaaaattacttgtaatgatccatactattggtctaaattagaaggcataaataaggaactatagaygtaaatgtttggcaactatctggatatcttttaaaaaagaaataaatgtgttctaaaaatatctcagtgtgatattgagttttacatctttaatttctgcattatcagtcccatacttatgctttcatccaacaaatattgagtgttttcatccaattcgcattcataattacagatacccaaaatatacttgggagcacagaaatgtaaaaaacaaaacttcaaattatctataatcattttaaggtacaaattgtgtcagaataaaaatttacttaaaggaaaaacccagcaatatttgttgagatatatcgtgtgtatatatatatatatatatgtatgtatgtatatatttatgtttgaatagcaatctttaaaccattttgggagtttattctgacatagaacttaaagtcatatggttaggttcagcatgtaacagcagatgagtttcttttataggctctgacaacactcttaattccacccatattggtcac

SEQ ID NO: 388 - DNA, 1001 bp, Homo Sapiens
  allele 501: 12-886-348 : polymorphic base T or C
  misc_binding 481..500: 12-886-348.mis1, potential
  misc_binding 502..521: 12-886-348.mis2, potential complement
  primer_bind 827..847: upstream amplification primer, complement
  primer_bind 399..419: downstream amplification primer
  misc_binding 489..513: 12-886-348 potential probe
gccaatgagaattaaggtcatcacaagtcttcctcaatggtgcagtttaggaaatttatttatttcatggtctttgcataaaatttttgtacaggtgttcaattcatatgttttggacataattcaaaagaaaaacatgtgttttcccaaagtaggctaatagaattttatagtatcattcatcctaaaacattgttgtaagctttgcttttcgtatatatttaaggattaaaaaaaaaacaatactaaagcaaggcttctcgtgattagtgtatacactgtggaatagcagatgttacaatgtaccctgaggacaaaagaggctgccaaatttgaacacatcagttttaacaaccctgaaactcatttttgccaaatgttttaagtacaggaaataacttgagccacactgtattttcttttttatttaaaacatgactaaaggttgagtctttcagaagagctgaggcaaatagccaattaaagctatgtccatgattygcaaacttctttgtgagatgattatgcacaataacccaacttcagctacctaaagtgacaggttaatgataagacccctcatgttttcaaaattacttgtaatgatccatactattggtctaaattagaaggcataaataaggaactatagacgtaaatgtttggcaactatctggatatcttttaaaaaagaaataaatgtgttctaaaaatatctcagtgtgatattgagttttacatctttaatttctgcattatcagtcccatacttatgctttcatccaacaaatattgagtgttttcatccaattcgcattcataattacagatacccaaaatatacttgggagcacagaaatgtaaaaaacaaaacttcaaattatctataatcattttaaggtacaaattgtgtcagaataaaaatttacttaaaggaaaaacccagcaatatttgttgagatatatcgtgtgtatatatatatatatatatgtatgtatgt

SEQ ID NO: 389 - DNA, 1001 bp, Homo Sapiens
  allele 501: 12-887-201 : polymorphic base G or A
  misc_binding 481..500: 12-887-201.mis1, potential
  misc_binding 502..521: 12-887-201.mis2, potential complement
  primer_bind 683..701: upstream amplification primer, complement
  primer_bind 184..204: downstream amplification primer
  misc_binding 489..513: 12-887-201 potential probe
agaaaagttctccaagtcccctctcgatccagggagtctagctggcttcacctctctgtttcattaatatcacatacatgggcacatgcacacacacacacacatacacacacaaaaaaacacaatcacccccatacacagagggctgctgagatgattgggttaaagcacatgtacttgtttcctggtgtatgagataggttgcttttaatccaagactttttagttagcaagtcagtggcctgtcatttcccttgaacatacagttcattgagactagaatccctgtttgttttgtaatcacagaaactgcttctacaagggctcactctgtctatctgtgcttcatgaagttaatatttcccatctaagagacaccaaaaaatgcccccaggtctgggatgaaataataagactgctgctataggcatgccaatgagaattaaggtcatcacaagtcttcctcaatggtgcagtttaggaaatttatttatttcatgrtctttgcataaaatttttgtacaggtgttcaattcatatgttttggacataattcaaaagaaaaacatgtgttttcccaaagtaggctaatagaattttatagtatcattcatcctaaaacattgttgtaagctttgcttttcgtatatatttaaggattaaaaaaaaaacaatactaaagcaaggcttctcgtgattagtgtatacactgtggaatagcagatgttacaatgtaccctgaggacaaaagaggctgccaaatttgaacacatcagttttaacaaccctgaaactcatttttgccaaatgttttaagtacaggaaataacttgagccacactgtattttcttttttatttaaaacatgactaaaggttgagtctttcagaagagctgaggcaaatagccaattaaagctatgtccatgatttgcaaacttctttgtgagatgattatgcacaataacccaacttcagctacctaaagtgacaggttaatga

SEQ ID NO: 390 - DNA, 1001 bp, Homo Sapiens
  allele 501: 12-887-467 : polymorphic base T or C
  misc_binding 481..500: 12-887-467.mis1, potential
  misc_binding 502..521: 12-887-467.mis2, potential complement
  primer_bind 949..967: upstream amplification primer, complement
  primer_bind 450..470: downstream amplification primer
  misc_binding 489..513: 12-887-467 potential probe
gatggcatggacccaaagagtgagcagcagcaagatttaatgtgaagagcaaaagaacaaagcttgcacagtgtggaaggggacccgagcaggttgcccctgctggctggggtggccagcttttattcccttatttgtccctgcccacgtcctgctgattggtccattttacaaacctctagctagccacagagcgctgattggtgcgttttacaatcctaactacagagtgctgattggtgcattttacaatcctcttgtaagacagaaaagttctccaagtcccctctcgatccagggagtctagctggcttcacctctctgtttcattaatatcacatacatgggcacatgcacacacacacacacatacacacacaaaaaaacacaatcacccccatacacagagggctgctgagatgattgggttaaagcacatgtacttgtttcctggtgtatgagataggttgcttttaatccaagactttttagttagcaagycagtggcctgtcatttcccttgaacatacagttcattgagactagaatccctgtttgttttgtaatcacagaaactgcttctacaagggctcactctgtctatctgtgcttcatgaagttaatatttcccatctaagagacaccaaaaaatgcccccaggtctgggatgaaataataagactgctgctataggcatgccaatgagaattaaggtcatcacaagtcttcctcaatggtgcagtttaggaaatttatttatttcatggtctttgcataaaatttttgtacaggtgttcaattcatatgttttggacataattcaaaagaaaaacatgtgttttcccaaagtaggctaatagaattttatagtatcattcatcctaaaacattgttgtaagctttgcttttcgtatatatttaaggattaaaaaaaaaacaatactaaagcaaggcttctcgtgattagtgtatacactgtggaatagcagatgttacaatgt

SEQ ID NO: 391 - DNA, 1001 bp, Homo Sapiens
  allele 501: 12-888-98 : polymorphic base G or A
  misc_binding 481..500: 12-888-98.mis1, potential
  misc_binding 502..521: 12-888-98.mis2, potential complement
  primer_bind 578..598: upstream amplification primer, complement
  primer_bind 148..168: downstream amplification primer
  misc_binding 489..513: 12-888-98 potential probe
agtaattaacttcctttatttacagtttagaaatatttacttctgatccaacttgtttataatttaaggtcaattcaagtttatttctttaagaagcattcttcaatggtttactgggaaactcagaaaatagggaacagggaagctggggactcacagaacaaagacatgaacatggctcaggaactaagttttcagtgcaactagacaagtatctgacatagaatggaggctcaatggatatttgtcaaataaataaaaatattctgctggaaaaaacacaggtacacacactacatttcctactactggttataactcagtgtttccatcacatgagagaagtccttaacagccacactttcgattcagaacagcccctaattacacctgaaagttaccagctgaaaggcccagaactgtctctacagtcacttagatcatcccaagacttttgcagtttgcgaggtcatctgcataaaaatgtatttttgaaaaagrttcataacaactgccaggatattgtttcttacagcaggaatcatggaaaaatatccagtcttctatatcaaggaagcttcttgctggtgagatttagcaatgggtatattgatttcatctcaaggtaattagtgtcactttttggatccctaaaccttagacaaaaaataaatttattcactggctaagtaatttttcaagagagtgattaatgaagaaattatgcaaaacacttgaccagtattcctcaaacctgtccaggacataaaaaacaaggaaagtcttacatgttgtcacagctaagaggagcctaaatgtgacaactaaatgtattaccttggatgggatcttggaacagaagaaggacattaagtaaaaactaaggaaatctgaataacatacgaacttcattaacaatagtgggtgaatactggtacaataattataacaaatatatcatactaattgtaacaaataagatgctaataacagaggaacag

SEQ ID NO: 392 - DNA, 1001 bp, Homo Sapiens
  allele 501: 12-888-203 : polymorphic base C or A
  misc_binding 502..521: 12-888-203.mis1, potential complement
  misc_binding 482..500: 12-888-203.mis2
  primer_bind 683..703: upstream amplification primer, complement
  primer_bind 253..273: downstream amplification primer
  misc_binding 489..513: 12-888-203 potential probe
atgtaacctctgctcccaatttaatgatctacatttgtaatcacaagttaccacatcatgcattacactgtagggcgtaatccaggtacaaagttagctttgtatagtaattaacttcctttatttacagtttagaaatatttacttctgatccaacttgtttataatttaaggtcaattcaagtttatttctttaagaagcattcttcaatggtttactgggaaactcagaaaatagggaacagggaagctggggactcacagaacaaagacatgaacatggctcaggaactaagttttcagtgcaactagacaagtatctgacatagaatggaggctcaatggatatttgtcaaataaataaaaatattctgctggaaaaaacacaggtacacacactacatttcctactactggttataactcagtgtttccatcacatgagagaagtccttaacagccacactttcgattcagaacagcccctaattacacctgaamgttaccagctgaaaggcccagaactgtctctacagtcacttagatcatcccaagacttttgcagtttgcgaggtcatctgcataaaaatgtatttttgaaaaaggttcataacaactgccaggatattgtttcttacagcaggaatcatggaaaaatatccagtcttctatatcaaggaagcttcttgctggtgagatttagcaatgggtatattgatttcatctcaaggtaattagtgtcactttttggatccctaaaccttagacaaaaaataaatttattcactggctaagtaatttttcaagagagtgattaatgaagaaattatgcaaaacacttgaccagtattcctcaaacctgtccaggacataaaaaacaaggaaagtcttacatgttgtcacagctaagaggagcctaaatgtgacaactaaatgtattaccttggatgggatcttggaacagaagaaggacattaagtaaaaactaaggaaatctgaat

SEQ ID NO: 393 - DNA, 1001 bp, Homo Sapiens
  allele 501: 12-888-315 : polymorphic base T or G
  misc_binding 481..500: 12-888-315.mis1, potential
  misc_binding 502..521: 12-888-315.mis2, potential complement
  primer_bind 795..815: upstream amplification primer, complement
  primer_bind 365..385: downstream amplification primer
  misc_binding 489..513: 12-888-315 potential probe
actatggaactaaaaatattagctgacttacaaaatagtgaaatctttattggcaaaacatttaaaaagcaaatgacttggagatagagaaaaaaaagcaatgccacctaatatgtaacctctgctcccaatttaatgatctacatttgtaatcacaagttaccacatcatgcattacactgtagggcgtaatccaggtacaaagttagctttgtatagtaattaacttcctttatttacagtttagaaatatttacttctgatccaacttgtttataatttaaggtcaattcaagtttatttctttaagaagcattcttcaatggtttactgggaaactcagaaaatagggaacagggaagctggggactcacagaacaaagacatgaacatggctcaggaactaagttttcagtgcaactagacaagtatctgacatagaatggaggctcaatggatatttgtcaaataaataaaaatattctgctggaaaaaacacakgtacacacactacatttcctactactggttataactcagtgtttccatcacatgagagaagtccttaacagccacactttcgattcagaacagcccctaattacacctgaaagttaccagctgaaaggcccagaactgtctctacagtcacttagatcatcccaagacttttgcagtttgcgaggtcatctgcataaaaatgtatttttgaaaaaggttcataacaactgccaggatattgtttcttacagcaggaatcatggaaaaatatccagtcttctatatcaaggaagcttcttgctggtgagatttagcaatgggtatattgatttcatctcaaggtaattagtgtcactttttggatccctaaaccttagacaaaaaataaatttattcactggctaagtaatttttcaagagagtgattaatgaagaaattatgcaaaacacttgaccagtattcctcaaacctgtccaggacataaaaaacaaggaaagtc

SEQ ID NO: 394 - DNA, 1001 bp, Homo Sapiens
  allele 479: 12-889-518 : polymorphic base G or A
  misc_binding 459..478: 12-889-518.mis1, potential
  misc_binding 480..499: 12-889-518.mis2, potential complement
  primer_bind 976..995: upstream amplification primer, complement
  primer_bind 426..445: downstream amplification primer
  misc_binding 467..491: 12-889-518 potential probe
ttccaccccaaaaaatatgtttgagtttctaacttgcagtacctatgcttatgttattaagaaataaggtcatcgcaaatgtaactagctaagcttagatgagttcatactacagtagggtgggctcctaatccagcgtgatcattgtccttataagaagatggccatgtgaaaacaacacagggagaatgccatgcggcctcaaagttagggattggagttatgcagttgtaagtcaaggaccaccaaaagttgtcagcaaaccactggaagttaggagaggtagggaagggtttaatccaggtttcggagggaatgtggtcctgctgagaacttgatttcagacttgcaaccaccagaactgtgagacaataaaattcagttgtttcaagctgcccaatttatggcagtttatagtgcaaccctagcaagctaacacaataggctattattattaactactctttcttacagcttarggccaacatcaggatttccctcattttacagcttaccagcatcagaataagggaagaaacctattagatttttttcttgtttccttctttctttctgtggttgattgagctctaaaaacatatgttattaatgggaggtacacagaattagaagctcgcatatctcatgtctgagttagacaaaattttatcttaatctcaacaagatagtactttcatgagactgagagaaggaaactggccaatggcttttacctgctcattcatttcctagtacatatttataaatacaatgctctatgaatattatattttatccacattgcttccaaccttcttttcaaagggagaaaatttaagtgtctgaaaagtcctaagtgaatctttaaaaaggggggacaagtcattccctaaacactttgcgaagagtcagaatgagctagcatggtccctgagcagaagaactctaattgagagaatctaccaatatatgtatcctttcttagtgtctatatgcagata

SEQ ID NO: 395 - DNA, 1001 bp, Homo Sapiens
  allele 501: 12-894-266 : polymorphic base T or C
  misc_binding 481..500: 12-894-266.mis1, potential
  misc_binding 502..521: 12-894-266.mis2, potential complement
  primer_bind 745..765: upstream amplification primer, complement
  primer_bind 309..329: downstream amplification primer
  misc_binding 489..513: 12-894-266 potential probe
tagttgaggcatatcagagttcattttgtaatttttcataactctgtattatttatttcattttttaccaaaacacacagggtttgatctaggtcctgctgctcactgcacagaaagcgaatcactgagatgacagatattgccaaggaagaaggctttaattaggtgctacaggagatgggagctcagtctcagatccatctccctgactgactaaaactaggagtttatatagcaagaaagaaatataacaatgttcaagaactaggaaagggctaggaagcaatcataatgaatgaggggcctgtcatctcattgtgaggatgtggtgatctggtgagattcggttttttgatgcttttttaaagaggccagaaggtcctttcctcaaagaaaacaaatgtaagcttgaagctttaagatcggaaaggttaatttctatgtttatccaaaagaacagtctatgggactattggggcagtttcatatgtttgtagtacygaggaactttacaagattcctgcttcggtggcactaccttcattcagtataacaaagtccagattccttagtgggttatttctgcagtggaggaaaagggattgtttgtttcctcgtattttgtttgtcttttgtaatacatgaactactcaaaaatttatccctttgctacattctttttgaccatctaatttctaagggtcacttctttctgttttgattttttctcctacagaggctataggtttcaaaaactgtcacttcacatcatacatgctgttaagtcccttccctgcaaaccatgctctggtcttttctcctgcagacttacttttggaagttggtaaggtcaatcttatggccatcattttctctctcctctcttcccatagtttttcatgacctgttttttcttgccacaaagacttacagtaggataggacagcaagagattgcttactggacatttacaattttattcttaaaatttcaagttattt

SEQ ID NO: 396 - DNA, 1001 bp, Homo Sapiens
  allele 501: 12-895-391 : polymorphic base G or A
  misc_binding 502..520: 12-895-391.mis1, complement
  misc_binding 481..500: 12-895-391.mis2, potential
  primer_bind 870..889: upstream amplification primer, complement
  primer_bind 348..368: downstream amplification primer
  misc_binding 489..513: 12-895-391 potential probe
taatagagacggggtttcaccatgttggccaggatggtctccatgtcttgacctcatgatccgccctcctcagcctcccaaagtgctgggattacaggcgtgagccactgcgcccagctggtacatgtctatttttattttatagttcctagcctactatttcaaggaatgcaagttaggaattcaattcaataaacattaattcaactgctagtatttgccaagtattggaatacaagataaaaagtatagcagctgtatataagccttctttgtttcatgaactaattttttgtgtgtctactagtttctagacactgtcctggcattaatataatagtaaataagagaaacccaaccttcaagtgttcacatcctagtaggtttttagtctcagttgtttaacgtatgttgaatcagcacaggaagataagtgttcttacgtaatggttacttaggcaacctgacagcctgagttaagtagcccatccaccttgaagrgcacattgcttagtgatttgaacatctgtgtcctccaaatacaggaaggaggctatcatttagtcagtattatataatgctgacaaattcttagtaaacattcatgtactcccacaccgtataaaaacttctttggtttccctttggaactaacagtgttgtaattccgatatgcatctacagtagttaatcctttacagcctagatttgtatcttccccttaatgtataaatagctttcaaattttagcattagcataattttcaaagttctctgaggtgaaaatctgcccagtttattttatgtaaaattgtgatatcctaacctatgtgagacttcctctttatagtcctggaattctaattccagtattagagtcttttctggccactcattcaatcttttgaccaaattttcaggggaaaattgacattactgttagaaggtatttggcattttgtaccaagtcacaatacatatgttcttctcccctttctttg

SEQ ID NO: 397 - DNA, 1001 bp, Homo Sapiens
  allele 501: 12-896-140 : polymorphic base T or A
  misc_binding 481..500: 12-896-140.mis1, potential
  misc_binding 502..521: 12-896-140.mis2, potential complement
  primer_bind 622..640: upstream amplification primer, complement
  primer_bind 138..158: downstream amplification primer
  misc_binding 489..513: 12-896-140 potential probe
  misc_feature 712: n=a, g, c or t
ataaaatactggcaaactgaatccagcagcacatcaaaaagcttatccaccatgataaaaaaattaaatttttaaaatttagagatggggcttgctttgtcacctaggctggagtacagtggcacttggaacagtgctaggaacacacaaggtattcgatgactatcttttaatcaatgattaaatcataatcttctatgttggacaccaagcatgtgtatgcatttctacatgtgtaaggaacaataaaaggagtgaagtttattgtttgtttatttttgttgttatttttatcacatatatatgttaaaattgaaatggcctattgttcattgatgtgttatgacttctatgaaagaaaaggtgccctacttcaaaaaacaaggcaaaaaaaaaattcccaaaagtagcataagatgttataataccaaacatgcacatttaattttaagtattggaaacaagaatattttgtaagtttttttgaggtatacaccagcwattgtttacatgagacttattcagattggtatgaaatgttcctaattcaaatttcaaccaggatcacacttaattttataatcatgtgtcggaatgcttaaagtaatgagcttctgaaggcttacagccttacaccccattggccatgtcttaatgacaacacaatgagacttaatgtttcttttcatgaaacatccatctgagagcaacnaattttgttgaaagctttaaattaatttatgccattcattatttttttttctgaaagtttagtccctttgtgccaagcatgtcgtctttagttgactgtagcatgttgttttcatgtaagcttttattttctcattcaatgtcctatgcacttagtattttccatcatttccttgttctgtcccttctgattctggacattatttctaagcagatacatgaaacatatcactcacagaattcttggtattaaccatatcatgggttacatagcaagaaaggtcaaggag

SEQ ID NO: 398 - DNA, 1001 bp, Homo Sapiens
  allele 501: 12-897-115 : polymorphic base T or C
  misc_binding 481..500: 12-897-115.mis1, potential
  misc_binding 502..521: 12-897-115.mis2, potential complement
  primer_bind 595..615: upstream amplification primer, complement
  primer_bind 106..126: downstream amplification primer
  misc_binding 489..513: 12-897-115 potential probe
gataggagaccagcctggaggaggaaatgtttcaaggaaagcatggctgtgctagttgctgctgaggaagggatcaaggaaaatgagacagagatttagccttagcaaaccattgctcattggcagcctccataagatctgtttgactggagtgatcagatgaaagcctgatgggaatgagttgtagagcaaataggaggtcaagaaagtggagacaatgcaaggcatataataactcttctgaggactttccattgaaaagagaaacaaggtggtagctggagaaaaaataagtattatttttagatgggtaataactgagatatgtttatatctcagagtgattctgtttctgcagttgatatcagtgaccattttaagtctcttaaagtactttcatccgtaatttctgttacacaacacttaattgcttctcttcctacctgggctggtttattctgtccttttgctcagtcacctactctccaagagatgactacyatgtatagttgtgcaggttgtaaatggtaggaacataagcggcacagtttacaccaactaccttgtaaattgtgtctccagagtcataccgtgcacacttagtctaactctatgagctgacccttattaccagccccagaacacaatttttatttgaagcacatggaaacaaattctatgttggtgttgtgggcctacagtaagtagtggaagcgtggttaaccaatcctgaagctacaccacagtagcaataatactatacctacagaagaaaaatgaatcagatgcagtagaaaatgttggattcctaaaaaatgtccacccccaactaaaatcattgtcaaaaataataaaacaacaagagcttttctccctccatttaggcttcattttcaaagcaacaaactgaagtataggtagtaaatttctacattgagagtcagtttgcaagttggagagaaagcactgcaaatccaccctgcctgttcaaaacataagaa

SEQ ID NO: 399 - DNA, 1001 bp, Homo Sapiens
  allele 501: 12-897-225 : polymorphic base G or A
  misc_binding 481..500: 12-897-225.mis1, potential
  misc_binding 502..521: 12-897-225.mis2, potential complement
  primer_bind 705..725: upstream amplification primer, complement
  primer_bind 216..236: downstream amplification primer
  misc_binding 489..513: 12-897-225 potential probe
aaagcaaagaggaccaggtatatctctggagttttccagcatgtttatgggtctagtcaaggaagaggagccagccaaagacatgaagaagaagctgccagtgaatgtgagataggagaccagcctggaggaggaaatgtttcaaggaaagcatggctgtgctagttgctgctgaggaagggatcaaggaaaatgagacagagatttagccttagcaaaccattgctcattggcagcctccataagatctgtttgactggagtgatcagatgaaagcctgatgggaatgagttgtagagcaaataggaggtcaagaaagtggagacaatgcaaggcatataataactcttctgaggactttccattgaaaagagaaacaaggtggtagctggagaaaaaataagtattatttttagatgggtaataactgagatatgtttatatctcagagtgattctgtttctgcagttgatatcagtgaccattttaagtctcttaaartactttcatccgtaatttctgttacacaacacttaattgcttctcttcctacctgggctggtttattctgtccttttgctcagtcacctactctccaagagatgactaccatgtatagttgtgcaggttgtaaatggtaggaacataagcggcacagtttacaccaactaccttgtaaattgtgtctccagagtcataccgtgcacacttagtctaactctatgagctgacccttattaccagccccagaacacaatttttatttgaagcacatggaaacaaattctatgttggtgttgtgggcctacagtaagtagtggaagcgtggttaaccaatcctgaagctacaccacagtagcaataatactatacctacagaagaaaaatgaatcagatgcagtagaaaatgttggattcctaaaaaatgtccacccccaactaaaatcattgtcaaaaataataaaacaacaagagcttttctccctccatttaggcttcat

SEQ ID NO: 400 - DNA, 1001 bp, Homo Sapiens
  allele 528: 12-898-49 : polymorphic base G or A
  misc_binding 508..527: 12-898-49.mis1, potential
  misc_binding 529..548: 12-898-49.mis2, potential complement
  primer_bind 558..576: upstream amplification primer, complement
  primer_bind 6..26: downstream amplification primer
  misc_binding 516..540: 12-898-49 potential probe
tctgttttgaactgggcaacagaaggctttggaaggaggaactcttgttgggggttggggaaggaaatgtaactaacagataattcaatgtgtttgaactttcagtacatttattgatatgtatttgacacatcagaaggcacatttaagaaaatattagagattggcatgttgacaactaaacaccagatgaagtgagaaattattaactccagaacatacaaaatgttgtatgagaatggaaaactaacatgaaggtctatataacagttctaaaatgttaatatcacaagagggagtctctctctctctacatacacacacacacatacacacacacacacacgataaatcaagtaataatagtagcagcataacatgtatgaatacaaaaggaaatgtcttaaaaatagctaaaaggtttgacagtatattcctctgaggaaggacttgggtgcagagaatattagggcaagggattacactttattattcttcagttttaaattactcccatatgtcactttractaaatgagattaagttaatatttaaaagagaaagccctaatggttctcaaaatttatatagcatttcttatttttaaaaagcttttaaatataatcttagctatttccttttccttaaatactactgcacagcattatacctgttcaccttgattaaacaaaactttttttctagattttaaattaaatattttgggagtgtgttccttatgctatattattgataaaaatgtgtatctaatatttgagtcgtattagtccattttcatacttctatgaggaaataccagagactgggtaatttataaagaaaaagaaatttaatggactcacagttccacatggctggtgaggcctcacaatcatggcagaaggcaaaggagaagcaaaggcatatcttacatggtggcaggcaagagagtgtgtgtgtgggaactgccctctataaaaccatcagatcttgtaggactt

SEQ ID NO: 401 - DNA, 1001 bp, Homo Sapiens
  allele 501: 12-164-119 : polymorphic base T or G
  misc_binding 502..520: 12-164-119.mis1, complement
  misc_binding 481..500: 12-164-119.mis2, potential
  primer_bind 600..619: upstream amplification primer, complement
  primer_bind 116..134: downstream amplification primer
  misc_binding 489..513: 12-164-119 potential probe
  misc_feature 152,354,445,913,947..948,951,956,963: n=a, g, c or t
ccaatgccctcccgttacagctgggggacccaagacctatagagaggatgtgactcatccaaggtcacacagcatcttggtgccgttgaagctattgttttctcccttgcctggctcacctcctctacccttgggcctgagcaagccaaaangatttgggagcccctgaggctctctcaaaggccacgttaatggggagctggcatggagcctctcccaacttcattaagccatccaaggtcagcacggaagcctgccaagctaaccctcagaaaacgccggctgaaaggaaacaaggcttgccagagcttttgcgctgggatggggaccattcctggcaaacaaggtggggangggaggaccgggccagcctttcaaagcccttcgtgaacaaatgcttggactgcagcctgctctggtcattgtcccctccaagtcagcaganaacagccaaactcttcagtctagcagggaaaatggagaatggactggagtctgtgkgtgtggggacagtgccaatgagagcccaccctgaagatggaagggaaaaggcaggaagatggtgaagctaggtagggggagaccatcccatcctgagggtaactcttagttgccagtccccagcccttgggcatggaggtcagttttaaataacactgattggccgggcacggtggctcacgcctgtaatcccagcactttgggaagcaaaggccagcggatcacgaggtcaggagatcgagaccatcttggctaacatggcgaaaccccgtctctactaaaaatacaaaaaaattagccaggtgtggtggcgggcgcctgtagtcccagctgcttgggaggctgaagcaggagaatggcgagaacctgggaggcggagcttgcagtgagccaagactgcaccactgcactncagcctgggagacagcaagactccgtctcaaaannaanaaaanaaaaaanaaaaaataacaccgatcacctcccttcatgtcagggca

SEQ ID NO: 402 - DNA, 658 bp, Homo Sapiens
  allele 501: 12-168-84 : polymorphic base C or A
  misc_binding 502..521: 12-168-84.mis1, potential complement
  misc_binding 482..500: 12-168-84.mis2
  primer_bind 566..584: upstream amplification primer, complement
  primer_bind 105..125: downstream amplification primer
  misc_binding 489..513: 12-168-84 potential probe
gagttgagcatagaagcagcagtctaacccctgagaatgagagaggggtggaccctagaggaaaatcaggggcccgtttccagaagagaaatatatgccgggcagacaggaacagagattgatggccctactctctccccagccttctgatatctccctagctcccaccttccctcacaacttctcttggggtcagacctggataccctcatgttcaaacgtctctgagggaccacagagaccacatgtcatcgtgtgtcctttttcaccttgctatgtgactgtgtgggcgaggcaggcaccctctctgagcctcttcatcttcctctgtaaaataagagctggggttggcatatgagcaggtgaagggatagcccgctgactcttccttgcacctgccccatgcagatagcgtgctgagtgagagcctcaggcttacagctgcccccttcatcacccgcgaggttgtggtggacctggccatgcccatggcagacgggmgagaattcaacctgcgacgtggtgaccgcctcctcctcttccccttcctgagcccccagagagacccagaaatctacacagacccagaggtaaatggcaggggcgcctggtcatatggggtctgtgggagaacaatcagtgactttgggatgagcca

SEQ ID NO: 403 - DNA, 939 bp, Homo Sapiens
  allele 501: 12-168-365 : polymorphic base C or G
  misc_binding 481..500: 12-168-365.mis1, potential
  misc_binding 502..521: 12-168-365.mis2, potential complement
  primer_bind 847..865: upstream amplification primer, complement
  primer_bind 386..406: downstream amplification primer
  misc_binding 489..513: 12-168-365 potential probe
ggatccatgcactttaacaatgtcgtcaggactactcagttcctctccacctctcagccctgtttcccactgggttggctccagtctcaggctggcagtagctgttggcagctcaaggctgacttcctcctggctctgtgagactctgaatctcttacaatgttcccaccaagagtcccaagactgtgtctcattggctttctttgggtcatgtgtccatcctgaaccaatcacagggctcagagggatgctctgattggccagtcacagccccatcccaggagttgagcatagaagcagcagtctaacccctgagaatgagagaggggtggaccctagaggaaaatcaggggcccgtttccagaagagaaatatatgccgggcagacaggaacagagattgatggccctactctctccccagccttctgatatctccctagctcccaccttccctcacaacttctcttggggtcagacctggataccctcatgttcaaasgtctctgagggaccacagagaccacatgtcatcgtgtgtcctttttcaccttgctatgtgactgtgtgggcgaggcaggcaccctctctgagcctcttcatcttcctctgtaaaataagagctggggttggcatatgagcaggtgaagggatagcccgctgactcttccttgcacctgccccatgcagatagcgtgctgagtgagagcctcaggcttacagctgcccccttcatcacccgcgaggttgtggtggacctggccatgcccatggcagacgggcgagaattcaacctgcgacgtggtgaccgcctcctcctcttccccttcctgagcccccagagagacccagaaatctacacagacccagaggtaaatggcaggggcgcctggtcatatggggtctgtgggagaacaatcagtgactttgggatgagcca

SEQ ID NO: 404 - DNA, 1001 bp, Homo Sapiens
  allele 501: 12-170-299 : polymorphic base G or A
  misc_binding 502..520: 12-170-299.mis1, complement
  misc_binding 481..500: 12-170-299.mis2, potential
  primer_bind 781..799: upstream amplification primer, complement
  primer_bind 296..315: downstream amplification primer
  misc_binding 489..513: 12-170-299 potential probe
  misc_feature 29,36..37: n=a, g, c or t
attaaacctattttttaaaaaataaatanaataaannaattacccagtctcaagtatgtctttgtcagcagcatgaaaacagactaatacaatgcatatttattgagcacctgctacgggccgggtgatggggacatagaggtgattgaaatagatcaggctcccacctgcaggagacaagaccccttgcttctttttactgggggtaagacagataataagcaatttggtattgaaagggcttcctgctgtgggcctgtcctgcagcttctttcccacaggaactccccaccctcaatgagtgacattcagaagacccttggcctcatgggaggtcatgcctggccagccctgggtgtgggatggtgaatctgtaacccctactctctgtgctctgtccctgcaggggacaaggaccacatgtgcagtgtcaaaagtcgcctgtggaagctgctatccccagccaggctggccaggcgggcccaccggagcaaatggctrgagagttacctgctgcacctggaggagatgggtgtgtcagaggagatgcaggcacgggccctggtgctgcagctgtgggccacacaggtgggtgtgaatgtgcaagtgggtgtgtgcaggtgtgcatgtgtggttgcgatatgaacgcatgtgtgtgtgcatgtctgtgcacctgtgcaggtgtgcacatgactatgcctgtgtgtgcatgtgtatgtaggtgtgcatttgtgagtgtgtgctgatgtgagtgtgggtgtgtgcacacatacccactgcccaaaccagttccctgacttcctttactgtcaaatagcatcacgaacagaaacattcattcggtattcttttctttttttttcttttgagacagagtctcgctctgttgcccaggctggagtgcagtggctcgatctcagctcactgcaacctccgcctcccaggttcaagtgattctcatgcctcagcctcccgagtagctgggaccacagttgcctgcc

SEQ ID NO: 405 - DNA, 1001 bp, Homo Sapiens
  allele 501: 12-171-360 : polymorphic base C or T
  misc_binding 482..500: 12-171-360.mis1
  misc_binding 502..521: 12-171-360.mis2, potential complement
  primer_bind 142..160: upstream amplification primer
  primer_bind 521..541: downstream amplification primer, complement
  misc_binding 489..513: 12-171-360 potential probe
  misc_feature 253: n=a, g, c or t
ttgaaaagctgatagaagacactgtaatgatcattcaacacattctgggcactggagaaggtatttggccacttgtaaagaatttagtgccctgtgctttcagtggatgataagaaacttctggctggagttcgagctgaacatttcagaccatctcaccactcctcaaccaaaggaaggtgaattgtggtttctgccaactttgactaacctctgaattcatccatccattcatccagcaaaattttatggnaagatttgcatggaggtaggcaaagtgctagatgcaggagagacatgcctatagcagacaaggtcctactactggggagatcacagcccagatggggaggcaggcgctaatcagatcgttgcttaaacctatgtgaaattacaactggaatggaggccacccaagagagacacagagaactttgaaaatccataactgggggatctgacctattgagagattaggaaaggcttgcaggaggaggtggyattctatctgggagctctagggtgaggaggcaaataactggatgaagaagagaggaagagcattcgaggcagagggaacagcatgtgcaaagactcaaggcaggaaggaatttataatagtaagtatgagatcagcatggctggacacggggaggcaggagatggtagtggaagatgaagtcagagagtgttaaatgactctggcctcatggagtcttataggccactgtgaggaaatttaccctctcctcccaacccgttctgcagcaaatcaaacagaaaactcccacctttccatccaccctcgcttatagcataaggatgtgaaaaaattccactgctcttatgatttttgcaatttgaaaaatagaacaacgcatccatacaattggggttgcttataacttggggagtttgagttacttaaggagaaaaggaagaagagcaaagagaaaggcaagaagactaagaataaaaggaagaagtaagtgaggagaagg

SEQ ID NO: 406 - DNA, 1001 bp, Homo Sapiens
  allele 501: 12-173-59 : polymorphic base A or G
  misc_binding 481..500: 12-173-59.mis1, potential
  misc_binding 502..520: 12-173-59.mis2, complement
  primer_bind 443..460: upstream amplification primer
  primer_bind 901..921: downstream amplification primer, complement
  misc_binding 489..513: 12-173-59 potential probe
ccagcctgagtgcaccaccctttgaacaaatgtatccagtgatgaaaatttgcctttgccccggcttgcctgtaatcccagcactttggggaggccgaggtgggcggatcacttgaggtcgggagttcaagaccagcctggccaacatggcgaaatcccgtctctactaaacatacaaaaattagtcaggtgtggcggtgcgtgcctgtaatcccagctattcaggaggctgaggcaccagaattgcttgaacccaggaggtggaggttgcagtgaactgagactgcgccacggcactccagcctgggcgacagagcaagactctgtctcaataaataaataattaattaaaataaaaaacagcttaaagagaaaaatggcctgcaaaccttttttatgatgctatttttattaatataaagtcctgtttattgagaccctttaaatgcctgcgagagaccctacagacagtatgtctactcctcacagcatctctatgargagaaggagggttgtgcccacttcatagatgagaaaactgagaggtgaggtgacttgcctggggccacatagctcataagctgtagaactctgcaggcagatttactgtcccaggagcaaatgctggatgagcaactcctgttctttgggctcaaggggactggtgatgggacaattcttctcgacttcaggagctgacagagccagaggcacctaaacttgggtacatcttgtaagacacataatgaggtccctctagctttagctggagggagataaaagaaccccagacctctgaatgtcccagaggctagtctcttctcagagcagcactggggtttgggggcttccctgggcctcagcctccaggcacccccaggattcccagagagacgctgtgattggcaggaggcaggatatccccagggaaacccatcttcacgcctgggtgacccccactgccgcctccttcttaactctgcaggaaatcagagctggca

SEQ ID NO: 407 - DNA, 1001 bp, Homo Sapiens
  allele 501: 12-175-214 : polymorphic base A or G
  misc_binding 481..500: 12-175-214.mis1, potential
  misc_binding 502..520: 12-175-214.mis2, complement
  primer_bind 287..306: upstream amplification primer
  primer_bind 765..785: downstream amplification primer, complement
  misc_binding 489..513: 12-175-214 potential probe
  misc_feature 125,404: n=a, g, c or t
tattcagttagcattcatctttctttccctgattgtcttacagtctcatgatttattttgcatggttgttttggtccaatcagtatctgtgtttatttttttaacagtcttgctccttcttctanctggaatatcagtgccatgagagctgggatctttgttttgatctctgctttgtccccagcacccagcacaatgcttgacacatagtaggtgctcaataagttccactgaatgaatatacacaaccaatcctgataataaaagtttgttattgacctgttgggcattatgtgtctgttactgttatttgccataattatcaaatccttacaatctccttatgaggtacgtgctgtgattaggtccattttacagatgaggaaacagctacgtgacccaanggactcacagcttaaaaaaaggctagggcttaagacccattgcacagcctgagggtctgtgaccactggtggaggcaggggcgttgtggcttcccargagctgcctccacaccttacatccagagtccagccacttttcaccgatcttccctgccaccaccctcttctgggctgtcatctttcttctctttcctggaataatgcaatatcctcctggcagcggcttatcccttctttctctaatgtccattctccactgctaaacatcctccaatgcacaggacagccccacggcaaagaattctccatcgccaaatgtcagtagcactaaggttgagaaactgggctctggttgaaaaaccagacacattcttcatccagagcctggcataagcagctgagagtcagacttctagcaatgtgttagtaataagagtgaaagtcccaaagtttgtaaacaaattcctttttcatcaattagtattctcagttatctctaggataacatcattcattcatttattcaatgcatgtatttcatgcctgctctatggcaggcactgaagacacaacagtggacaaagcacacaaaatccc

SEQ ID NO: 408 - DNA, 1001 bp, Homo Sapiens
  allele 501: 12-177-183 : polymorphic base C or G
  misc_binding 502..520: 12-177-183.mis1, complement
  misc_binding 481..500: 12-177-183.mis2, potential
  primer_bind 664..683: upstream amplification primer, complement
  primer_bind 217..236: downstream amplification primer
  misc_binding 489..513: 12-177-183 potential probe
gaagggccatggtttaacttgtattctaggaggatccatctcaccgtgcatgctgagggctgggaagctggagaccagggaggaagggactgcactagtccgggcaaggtctctgccctcatagatttcacatttgggcagcagaggccatccagtaaagaaacaaatcagcataaatacagtgtcagatgctgaggacaagcaaacagcaggaggtgatggatgctgacacggagatggatgtgcctgtggccttggaggcagtcaggaaaagtctccaggcaggtggcgataggagttgagatcaagatgagagatcgcagctttgtaaagaactagaggaagaacattccaggagaaagagactacaaatccaaagaactctaaagaggcaaggggtttggtgtgctggagaaagagagcatcccaggaaggctgtggctgagtgagggggtggcaggagccactctgggagcagaccttgtcaggaagaggaggctsggctttatgctaagtgccctgggaagccatgagagagtttaagtaggaaagtaaatcaccatcatcctttaaatggaatcaatttagctttatacaaatctcattccattgtccctgttttttctcattcatttcatgatggaccagtgaaaatgcaaacacgttattggtctggcatttgggagtcatggccatttgagacatggttcagagtgtgtgtctgcaaggatgggagggtgatgagttggggaagagctggcagtgtactatcttattgccccaggaccttccgtggagcttcacagtggcctgggagagacaaggcaggtgcacccatgctatagttaggatgtttgacctttgcaaacctcatgttgaaatttgattcccaatgttggaggtgtggtctaatgggaggggtttgggtcatgggagttgatccctcatgaaaggcctggtgccctccccatggtaagaagtgagttctcactctagtagtt

SEQ ID NO: 409 - DNA, 1001 bp, Homo Sapiens
  allele 501: 12-177-366 : polymorphic base C or A
  misc_binding 481..500: 12-177-366.mis1, potential
  misc_binding 502..521: 12-177-366.mis2, potential complement
  primer_bind 846..865: upstream amplification primer, complement
  primer_bind 399..418: downstream amplification primer
  misc_binding 489..513: 12-177-366 potential probe
ctccctgggggagctttgaacagaaactcgatggaaatgagaggagcaaaccactggggcatctgaggaaagaatgttctggagagatgcaatggcaaatgtgaagatgggaagctctggggcaggttctaggagcaggagggaggcagtgtggccagcagccacggaaggctctgggcagagaagggccatggtttaacttgtattctaggaggatccatctcaccgtgcatgctgagggctgggaagctggagaccagggaggaagggactgcactagtccgggcaaggtctctgccctcatagatttcacatttgggcagcagaggccatccagtaaagaaacaaatcagcataaatacagtgtcagatgctgaggacaagcaaacagcaggaggtgatggatgctgacacggagatggatgtgcctgtggccttggaggcagtcaggaaaagtctccaggcaggtggcgataggagttgagatcaagatgagagatmgcagctttgtaaagaactagaggaagaacattccaggagaaagagactacaaatccaaagaactctaaagaggcaaggggtttggtgtgctggagaaagagagcatcccaggaaggctgtggctgagtgagggggtggcaggagccactctgggagcagaccttgtcaggaagaggaggctgggctttatgctaagtgccctgggaagccatgagagagtttaagtaggaaagtaaatcaccatcatcctttaaatggaatcaatttagctttatacaaatctcattccattgtccctgttttttctcattcatttcatgatggaccagtgaaaatgcaaacacgttattggtctggcatttgggagtcatggccatttgagacatggttcagagtgtgtgtctgcaaggatgggagggtgatgagttggggaagagctggcagtgtactatcttattgccccaggaccttccgtggagcttcacagtggcctgggagag

SEQ ID NO: 410 - DNA, 366 bp, Homo Sapiens
  allele 45: 10-128-45 : polymorphic base C or T
  misc_binding 26..44: 10-128-45.mis1
  misc_binding 46..65: 10-128-45.mis2, potential complement
  primer_bind 1..20: upstream amplification primer
  primer_bind 349..366: downstream amplification primer, complement
  misc_binding 33..57: 10-128-45 potential probe
ctgaaagcaatataacttccattcttttttattgtttctgtaatygtattcttgctgttccaaattgtttactgaataagtttgaataattggaattttgcttaatcttattcttactatagtgctgtgtttccttcagggtttttgggaaagccaaatggagctcagaaagctgtatggacctctgtgtgggtaagaaggaaactcaacgtttctattatgtacgatattttctattatgtacgatattttgattttcacgtgttgaactgatatagaagaaatgccaagattaggaatgttgtatgtgtttctatttttcaaagggcccacaaagagggagtcctgcagtacagacaaggcttc

SEQ ID NO: 411 - DNA, 366 bp, Homo Sapiens
  allele 63: 10-128-63 : polymorphic base A or G
  misc_binding 43..62: 10-128-63.mis1, potential
  misc_binding 64..83: 10-128-63.mis2, potential complement
  primer_bind 1..20: upstream amplification primer
  primer_bind 349..366: downstream amplification primer, complement
  misc_binding 51..75: 10-128-63 potential probe
ctgaaagcaatataacttccattcttttttattgtttctgtaattgtattcttgctgttccarattgtttactgaataagtttgaataattggaattttgcttaatcttattcttactatagtgctgtgtttccttcagggtttttgggaaagccaaatggagctcagaaagctgtatggacctctgtgtgggtaagaaggaaactcaacgtttctattatgtacgatattttctattatgtacgatattttgattttcacgtgttgaactgatatagaagaaatgccaagattaggaatgttgtatgtgtttctatttttcaaagggcccacaaagagggagtcctgcagtacagacaaggcttc

SEQ ID NO: 412 - DNA, 429 bp, Homo Sapiens
  allele 177: 10-123-177 : polymorphic base A or G
  misc_binding 157..176: 10-123-177.mis1, potential
  misc_binding 178..197: 10-123-177.mis2, potential complement
  primer_bind 1..18: upstream amplification primer
  primer_bind 412..429: downstream amplification primer, complement
  misc_binding 165..189: 10-123-177 potential probe
gcaatttgggtcataccgactttccattttgtggggtttctgtttaaatgtttgccaaagttggaaacgagattgaaatttaaggaaaagacaaaatgctgtgagatttgggctaacacgaacttctccctttgtcacgacccctccatcagatggcccctgagttctgcagcctcraggaaggcctgccctatctggacatggtgattgcagagacgctgaggatgtacccgccagctttcaggtgtgtggtagccccctcccctgcccgagtccccacctcctacccctaccccctgccccagcctgcaggtcagggccctcctccatcagttaccacttgtgtttctggagggcaacgcctgagtcctgggttcctttgtatccccatggcacctcaggtatctggcccgctttcctacaggttaa

SEQ ID NO: 413 - DNA, 429 bp, Homo Sapiens
  allele 402: 10-123-402 : polymorphic base A or G
  misc_binding 382..401: 10-123-402.mis1, potential
  misc_binding 403..422: 10-123-402.mis2, potential complement
  primer_bind 1..18: upstream amplification primer
  primer_bind 412..429: downstream amplification primer, complement
  misc_binding 390..414: 10-123-402 potential probe
gcaatttgggtcataccgactttccattttgtggggtttctgtttaaatgtttgccaaagttggaaacgagattgaaatttaaggaaaagacaaaatgctgtgagatttgggctaacacgaacttctccctttgtcacgacccctccatcagatggcccctgagttctgcagcctcgaggaaggcctgccctatctggacatggtgattgcagagacgctgaggatgtacccgccagctttcaggtgtgtggtagccccctcccctgcccgagtccccacctcctacccctaccccctgccccagcctgcaggtcagggccctcctccatcagttaccacttgtgtttctggagggcaacgcctgagtcctgggttcctttgtatccccatggcacctcagrtatctggcccgctttcctacaggttaa

SEQ ID NO: 414 - DNA, 349 bp, Homo Sapiens
  allele 136: 10-120-137 : polymorphic base A or G
  misc_binding 117..135: 10-120-137.mis1
  misc_binding 137..156: 10-120-137.mis2, potential complement
  primer_bind 1..16: upstream amplification primer
  primer_bind 333..349: downstream amplification primer, complement
  misc_binding 124..148: 10-120-137 potential probe
acctggtgtttccctcagattcacacgggaggcagctcaggactgcgaggtgctggggcagcgcatccccgcaggcgctgtgctagagatggccgtggtgccctgcaccatgaccctgagcactggccaagcccgragaccttcaaccctgaaaggtgagtactgccccttttaaaaagctctgaagggatgtgagtgtgtgggatagaaatttaccagtggaggcagcagccgggaggcacagacttagcaaaattgtccccaaatagtcaaaagttatggcaattcagatagatgtttgcaagacataatttccaaaggaaataattataccattttttagccacgc

SEQ ID NO: 415 - DNA, 349 bp, Homo Sapiens
  allele 140: 10-120-141 : polymorphic base A or C
  misc_binding 121..139: 10-120-141.mis1
  misc_binding 141..160: 10-120-141.mis2, potential complement
  primer_bind 1..16: upstream amplification primer
  primer_bind 333..349: downstream amplification primer, complement
  misc_binding 128..152: 10-120-141 potential probe
acctggtgtttccctcagattcacacgggaggcagctcaggactgcgaggtgctggggcagcgcatccccgcaggcgctgtgctagagatggccgtggtgccctgcaccatgaccctgagcactggccaagcccggagamcttcaaccctgaaaggtgagtactgccccttttaaaaagctctgaagggatgtgagtgtgtgggatagaaatttaccagtggaggcagcagccgggaggcacagacttagcaaaattgtccccaaatagtcaaaagttatggcaattcagatagatgtttgcaagacataatttccaaaggaaataattataccattttttagccacgc

SEQ ID NO: 416 - DNA, 420 bp, Homo Sapiens
  allele 39: 10-179-39 : polymorphic base C or T
  misc_binding 19..38: 10-179-39.mis1, potential
  misc_binding 40..59: 10-179-39.mis2, potential complement
  primer_bind 1..18: upstream amplification primer
  primer_bind 400..420: downstream amplification primer, complement
  misc_binding 27..51: 10-179-39 potential probe
  misc_feature 39,191: n=a, g, c or t
tgccacccagccactatgatcccctccatctctctgtcnactttagtcagataagctcaaagctagaacaaaggacccatatatgagcctacggatctgccttcaaacacttgagaagccctccaactcaccatgagaacactgaccccaatcgggatctttgctttgctccaacagccagacactcaganaggtcctcagacccagcaactaatggacttggtgggatggttgtcctcaaagcagccagcattttkatcaggctggcgtctggtcctgtatttttctgggatattcagaatctcttgacatgtatcttcacttaattgtgaatttaaaaaattatagatggatgtagatatagatatagatatagacatagagatagatatagatagacattttggagaagagtctctc

SEQ ID NO: 417 - DNA, 424 bp, Homo Sapiens
  allele 65: 10-180-65 : polymorphic base G or C
  misc_binding 46..64: 10-180-65.mis1
  misc_binding 66..85: 10-180-65.mis2, potential complement
  primer_bind 1..18: upstream amplification primer
  primer_bind 407..424: downstream amplification primer, complement
  misc_binding 53..77: 10-180-65 potential probe
  misc_feature 65,194..195,199..207,209,211..213,216,310: n=a, g, c or t
ctcaccatgagaacactgaccccaatcgggatctttgctttgctccaacagccagacactcaganaggtcctcagacccagcaactaatggacttggtgggatggttgtcctcaaagcagccagcattttbatcaggctggcgtctggtcctgtatttttctgggatattcagaatctcttgacatgtatmttnncttnnnnnnnnntntnnnaanttatagatggattagatatagatatagatatagacatagagatagatatagatagacattttggagaagagtctctctttgaagacttcctctnagagtacaagtccgtggttacaaccattttgtttctcagcaaacatggggaagtttgcttttcttctctgaggaagttaatataaatgtttattgacagtgcagtcatcaagga

SEQ ID NO: 418 - DNA, 420 bp, Homo Sapiens; identical to SEQ ID NO: 416
  allele 257: 10-179-257 : polymorphic base G or T
  misc_binding 237..256: 10-179-257.mis1, potential
  misc_binding 258..276: 10-179-257.mis2, complement
  primer_bind 1..18: upstream amplification primer
  primer_bind 400..420: downstream amplification primer, complement
  misc_binding 245..269: 10-179-257 potential probe
  misc_feature 39,191: n=a, g, c or t

SEQ ID NO: 419 - DNA, 391 bp, Homo Sapiens
  allele 123: 10-43-124 : polymorphic base A or G
  misc_binding 103..122: 10-43-124.mis1, potential
  misc_binding 124..143: 10-43-124.mis2, potential complement
  primer_bind 1..18: upstream amplification primer
  primer_bind 374..391: downstream amplification primer, complement
  misc_binding 111..135: 10-43-124 potential probe
  misc_feature 320,335..336: n=a, g, c or t
tgagcctcttctgtcgsccgcagagacagaactcaaggtggaagtaccggagtatctggggccgctgctgtttgtgaaactgcgcaaacggcacctccttaaggacgacgcctggttctgcarctggatctcygtgtagggccccggagccggggacgaggtcaggttcccttgttaccgctgggtggaggkcaacggcgtcctgagcctgcctgaaggcaccagtaagcgcggggctgvgggtgtcaggaggcctctggggtgygwgagaagctggggggatgcgcgtgtggagaagagggcgcaggatgggggtgctngaacctggagcgcmnnggtctttgggagtgtcgaaggggckgtggctgcagctggcacaaagtggctggag

SEQ ID NO: 420 - DNA, 391 bp, Homo Sapiens
  allele 133: 10-43-134 : polymorphic base C or T
  misc_binding 113..132: 10-43-134.mis1, potential
  misc_binding 134..153: 10-43-134.mis2, potential complement
  primer_bind 1..18: upstream amplification primer
  primer_bind 374..391: downstream amplification primer, complement
  misc_binding 121..145: 10-43-134 potential probe
  misc_feature 320,335..336: n=a, g, c or t
tgagcctcttctgtcgsccgcagagacagaactcaaggtggaagtaccggagtatctggggccgctgctgtttgtgaaactgcgcaaacggcacctccttaaggacgacgcctggttctgcaactggatctcygtgtagggccccggagccggggacgaggtcaggttcccttgttaccgctgggtggaggkcaacggcgtcctgagcctgcctgaaggcaccagtaagcgcggggctgvgggtgtcaggaggcctctggggtgygwgagaagctggggggatgcgcgtgtggagaagagggcgcaggatgggggtgctngaacctggagcgcmnnggtctttgggagtgtcgaaggggckgtggctgcagctggcacaaagtggctggag

SEQ ID NO: 421 - DNA, 391 bp, Homo Sapiens; identical to SEQ ID NO: 420
  allele 192: 10-43-193 : polymorphic base G or T
  misc_binding 172..191: 10-43-193.mis1, potential
  misc_binding 193..212: 10-43-193.mis2, potential complement
  primer_bind 1..18: upstream amplification primer
  primer_bind 374..391: downstream amplification primer, complement
  misc_binding 180..204: 10-43-193 potential probe
  misc_feature 320,335..336: n=a, g, c or t

SEQ ID NO: 422 - DNA, 391 bp, Homo Sapiens
  allele 194: 10-43-195 : polymorphic base A or G
  misc_binding 174..193: 10-43-195.mis1, potential
  misc_binding 195..214: 10-43-195.mis2, potential complement
  primer_bind 1..18: upstream amplification primer
  primer_bind 374..391: downstream amplification primer, complement
  misc_binding 182..206: 10-43-195 potential probe
  misc_feature 320,335..336: n=a, g, c or t
tgagcctcttctgtcgsccgcagagacagaactcaaggtggaagtaccggagtatctggggccgctgctgtttgtgaaactgcgcaaacggcacctccttaaggacgacgcctggttctgcaactggatctcygtgtagggccccggagccggggacgaggtcaggttcccttgttaccgctgggtggaggkcracggcgtcctgagcctgcctgaaggcaccagtaagcgcggggctgvgggtgtcaggaggcctctggggtgygwgagaagctggggggatgcgcgtgtggagaagagggcgcaggatgggggtgctngaacctggagcgcmnnggtctttgggagtgtcgaaggggckgtggctgcagctggcacaaagtggctggag

SEQ ID NO: 423 - DNA, 391 bp, Homo Sapiens
  allele 232: 10-43-233 : polymorphic base C or T
  misc_binding 212..231: 10-43-233.mis1, potential
  misc_binding 233..252: 10-43-233.mis2, potential complement
  primer_bind 1..18: upstream amplification primer
  primer_bind 374..391: downstream amplification primer, complement
  misc_binding 220..244: 10-43-233 potential probe
  misc_feature 320,335..336: n=a, g, c or t
tgagcctcttctgtcgsccgcagagacagaactcaaggtggaagtaccggagtatctggggccgctgctgtttgtgaaactgcgcaaacggcacctccttaaggacgacgcctggttctgcaactggatctcygtgtagggccccggagccggggacgaggtcaggttcccttgttaccgctgggtggaggkcaacggcgtcctgagcctgcctgaaggcaccagtaagcgyggggctgvgggtgtcaggaggcctctggggtgygwgagaagctggggggatgcgcgtgtggagaagagggcgcaggatgggggtgctngaacctggagcgcmnnggtctttgggagtgtcgaaggggckgtggctgcagctggcacaaagtggctggag

SEQ ID NO: 424 - DNA, 391 bp, Homo Sapiens
  allele 137: 10-43-138 : polymorphic base C or T
  misc_binding 118..136: 10-43-138.mis1
  misc_binding 138..157: 10-43-138.mis2, potential complement
  primer_bind 1..18: upstream amplification primer
  primer_bind 374..391: downstream amplification primer, complement
  misc_binding 125..149: 10-43-138 potential probe
  misc_feature 320,335..336: n=a, g, c or t
tgagcctcttctgtcgsccgcagagacagaactcaaggtggaagtaccggagtatctggggccgctgctgtttgtgaaactgcgcaaacggcacctccttaaggacgacgcctggttctgcaactggatctcygtgyagggccccggagccggggacgaggtcaggttcccttgttaccgctgggtggaggkcaacggcgtcctgagcctgcctgaaggcaccagtaagcgcggggctgvgggtgtcaggaggcctctggggtgygwgagaagctggggggatgcgcgtgtggagaagagggcgcaggatgggggtgctngaacctggagcgcmnnggtctttgggagtgtcgaaggggckgtggctgcagctggcacaaagtggctggag

SEQ ID NO: 425 - DNA, 417 bp, Homo Sapiens
  allele 369: 10-46-372 : polymorphic base C or T
  misc_binding 350..368: 10-46-372.mis1
  misc_binding 370..389: 10-46-372.mis2, potential complement
  primer_bind 1..18: upstream amplification primer
  primer_bind 398..417: downstream amplification primer, complement
  misc_binding 357..381: 10-46-372 potential probe
gagaaggaagttgtaccggtgagccctcctcccctgaccccacgtgagctgctgatgcttccagcacccatacttgatttccttcctgccccacaggtggggaaactggaaggacgggttaattctgaatatggctggggccaaactatatgacctccctgtggatgagcgatttctggaagacaagagagttgactttgaggtttcgctggccaaggggtgagagcaaggggaggctgggtgagagggaggtgtcctggtctagtggaagccaaggggcttatgggctgcactgcattggactggcccaggatcggtgcctgtggtcgtcatgttagagcctcagaatgatgctcaaaccctttgccycatcctgccctgaaggctggccgacctcgctatcaaagactctctaaa

SEQ ID NO: 426 - DNA, 417 bp, Homo Sapiens
  allele 35: 10-46-36 : polymorphic base A or T
  misc_binding 15..34: 10-46-36.mis1, potential
  misc_binding 36..55: 10-46-36.mis2, potential complement
  primer_bind 1..18: upstream amplification primer
  primer_bind 398..417: downstream amplification primer, complement
  misc_binding 23..47: 10-46-36 potential probe
gagaaggaagttgtaccggtgagccctcctccccwgaccccacgtgagctgctgatgcttccagcacccatacttgatttccttcctgccccacaggtggggaaactggaaggacgggttaattctgaatatggctggggccaaactatatgacctccctgtggatgagcgatttctggaagacaagagagttgactttgaggtttcgctggccaaggggtgagagcaaggggaggctgggtgagagggaggtgtcctggtctagtggaagccaaggggcttatgggctgcactgcattggactggcccaggatcggtgcctgtggtcgtcatgttagagcctcagaatgatgctcaaaccctttgccccatcctgccctgaaggctggccgacctcgctatcaaagactctctaaa

SEQ ID NO: 427 - DNA, 423 bp, Homo Sapiens
  allele 102: 10-47-103 : polymorphic base A or C
  misc_binding 82..101: 10-47-103.mis1, potential
  misc_binding 103..122: 10-47-103.mis2, potential complement
  primer_bind 1..20: upstream amplification primer
  primer_bind 404..423: downstream amplification primer, complement
  misc_binding 90..114: 10-47-103 potential probe
tggtctagtggaagccaaggggcttataggctgcactgtgctggatcagcccaagataggtgcctgtggttgtaatgttggagtctcaaaatatgctcaaamcctttgccccaaccttccttgaagcctggccgacctcgctatcaaagactctaaatgttctgacttgttggaacaatctggatgacttcaaccggattttctagtgtggccagggcaagctagctgatcagaccccctaccccaatactcctcccaggactcttactccagctcccacccaatccaggggaattgaaagaaccagggtggggagaccagagacttgggtccctctggtgggctagagtcaagtgggcatggttggtgggggttggaaggaccaagaactcagatcccacaacttgctcaacaactgccttt

SEQ ID NO: 428 - DNA, 423 bp, Homo Sapiens
  allele 124: 10-47-125 : polymorphic base A or T
  misc_binding 105..123: 10-47-125.mis1
  misc_binding 125..144: 10-47-125.mis2, potential complement
  primer_bind 1..20: upstream amplification primer
  primer_bind 404..423: downstream amplification primer, complement
  misc_binding 112..136: 10-47-125 potential probe
tggtctagtggaagccaaggggcttataggctgcactgtgctggatcagcccaagataggtgcctgtggttgtaatgttggagtctcaaaatatgctcaaaccctttgccccaaccttccttgwagcctggccgacctcgctatcaaagactctaaatgttctgacttgttggaacaatctggatgacttcaaccggattttctagtgtggccagggcaagctagctgatcagaccccctaccccaatactcctcccaggactcttactccagctcccacccaatccaggggaattgaaagaaccagggtggggagaccagagacttgggtccctctggtgggctagagtcaagtgggcatggttggtgggggttggaaggaccaagaactcagatcccacaacttgctcaacaactgccttt

SEQ ID NO: 429 - DNA, 421 bp, Homo Sapiens
  allele 183: 10-48-184 : polymorphic base C or T
  misc_binding 164..182: 10-48-184.mis1
  misc_binding 184..203: 10-48-184.mis2, potential complement
  primer_bind 1..18: upstream amplification primer
  primer_bind 403..421: downstream amplification primer, complement
  misc_binding 171..195: 10-48-184 potential probe
gcatgbttggtggggttggaaggaccaagagctcagatcccacaacttgctcaacaactgccttccccagagcgcgtgcgggactcctggaaggaagatgccttatttgggtaccagtttcttaatggcgccaaccccgtggtgctgaggcgctctgctcaccttcctgctcgcctagtgttycctccaggcatggaggaactgcaggcccagctggagaaggagctggaggtatggacatcagagccctgaggaagctcagcagtgaagtggggtggcctagtgccaatgatgctgctgcgggacccactgtgggcctggcttgctgccagccagcaaggacggattctgcaggagaggtcctgagggaccctggagaagctcagctgctcggcctccttcctacacgagagtacgtgcg

SEQ ID NO: 430 - DNA, 421 bp, Homo Sapiens
  allele 382: 10-48-381 : polymorphic base C or T
  misc_binding 362..381: 10-48-381.mis1, potential
  misc_binding 383..402: 10-48-381.mis2, potential complement
  primer_bind 1..18: upstream amplification primer
  primer_bind 403..421: downstream amplification primer, complement
  misc_binding 370..394: 10-48-381 potential probe
gcatgbttggtggggttggaaggaccaagagctcagatcccacaacttgctcaacaactgccttccccagagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggaggtatggacatcagagccctgaggaagctcagcagtgaagtggggtggcctagtgccaatgatgctgctgcgggacccactgtgggcctggcttgctgccagccagcaaggacggattctgcaggagaggtcctgagggaccctggagaagytcagctgctcggcctccttcctacacgagagtacgtgcg

SEQ ID NO: 431 - DNA, 419 bp, Homo Sapiens
  allele 33: 10-49-33 : polymorphic base C or T
  misc_binding 14..32: 10-49-33.mis1
  misc_binding 34..53: 10-49-33.mis2, potential complement
  primer_bind 1..19: upstream amplification primer
  primer_bind 402..419: downstream amplification primer, complement
  misc_binding 21..45: 10-49-33 potential probe
tccawtacctggtataaagtagatgatggagaygagttagctccactctcttcccccttggaggaatccgagtaggaagaagatgctttatgttgatagcagcccttgacctcttcccccacccagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccaggtgagaggactcaggatttctgctcccagtctctggcttttgagaaagctcagccccttatcaaaatttactgagcaccatctgcaaaggcactgggctaaggcacctgggagacgcgaaaggaggaaatgcaccaagtctctattcga

SEQ ID NO: 432 - DNA, 422 bp, Homo Sapiens
  allele 150: 10-39-148 : polymorphic base A or G
  misc_binding 130..149: 10-39-148.mis1, potential
  misc_binding 151..169: 10-39-148.mis2, complement
  primer_bind 1..20: upstream amplification primer
  primer_bind 405..422: downstream amplification primer, complement
  misc_binding 138..162: 10-39-148 potential probe
  misc_feature 415: n=a, g, c or t
atgtaggagagcaggaggtctgcgtctggttgggggcctggggccctgacctggccatgtgagcaggggcagagctggcttcagctccctggccctgctccgttggttggtaggtatgtggaaggaatcgtgagtctccactataagacrgacgtggctgtgaaagacgacccagagctgcagacctggtgtcgagagatcactgaaatcgggctgcaaggggcccaggaccgaggtaagaggagcccctgccctgagatctcagacacaaagcccaagagatcttcccagaatcccctgtgcttctgtgaaatctcccagaagcattttcaacacctatgagaactccagaggccttctcagattccactccctgtcacctagagacagktccccgtcctacacactgagaacntytaggt

SEQ ID NO: 433 - DNA, 352 bp, Homo Sapiens
  allele 222: 10-40-222 : polymorphic base A or G
  misc_binding 202..221: 10-40-222.mis1, potential
  misc_binding 223..241: 10-40-222.mis2, complement
  primer_bind 1..18: upstream amplification primer
  primer_bind 335..352: downstream amplification primer, complement
  misc_binding 210..234: 10-40-222 potential probe
tctgagmgtctgccctactcctgccttcgcagcttctaactctcttcaccccttgcagggtttcctgtctctttacaggctcgggaccaggtttgccactttgtcaccatgtgtatcttcacctgcaccggccaacacgcctctgtgcacctgggccaggtacttaccagagatgggcagctgggaatttggggcctggagtgagggaggggtctgtgtgcrggtggaccacggggctcgcgtgcttgghaggcactgactctggatccctgcccttccttagctggactggtactcttgggtgcctaatgcaccctgcacgatgcggctgcccccgccaaccaccaaggat

SEQ ID NO: 434 - DNA, 352 bp, Homo Sapiens; identical to SEQ ID NO: 433
  allele 250: 10-40-252 : polymorphic base C or T
  misc_binding 230..249: 10-40-252.mis1, potential
  misc_binding 251..270: 10-40-252.mis2, potential complement
  primer_bind 1..18: upstream amplification primer
  primer_bind 335..352: downstream amplification primer, complement
  misc_binding 238..262: 10-40-252 potential probe

SEQ ID NO: 435 - DNA, 432 bp, Homo Sapiens
  allele 354: 10-42-354 : polymorphic base C or T
  misc_binding 334..353: 10-42-354.mis1, potential
  misc_binding 355..373: 10-42-354.mis2, complement
  primer_bind 1..18: upstream amplification primer
  primer_bind 413..432: downstream amplification primer, complement
  misc_binding 342..366: 10-42-354 potential probe
  misc_feature 181: n=a, g, c or t
tatggtgagagctgagtgcccagggccctaaggaaggaggcagctgtggggacgtgtggcatcccagactgggggtcataaggctctcagccaccttttcctctccctcccaggtggctgtgggccagcatgaggaggagtatttttcgggccctgagcctaaggctgtgctgaagaagtncagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgyggttatagccctgccctcccaagtcccaccctcttcccatgtcccaccctccctagaggggcaccttttcatggtctc

SEQ ID NO: 436 - DNA, 300 bp, Homo Sapiens
  allele 42: 10-154-42 : polymorphic base C or T
  misc_binding 22..41: 10-154-42.mis1, potential
  misc_binding 43..62: 10-154-42.mis2, potential complement
  primer_bind 1..19: upstream amplification primer
  primer_bind 283..300: downstream amplification primer, complement
  misc_binding 30..54: 10-154-42 potential probe
gtttatgttagtattccccttttgtttacattgcctgataayttgtttccctttgtctcccccaagggaagcattcatttataatgaatttttcagctcagtgtgtttcagcaaacacttattgacacccacaaaccctgacactgtgccgtctccaggggaaacaaaagtgagagtcctgctgggtgtgtagtccctgcctaggacgggctcacattagtgggggatacacacatacaaatgctcacactgcagtattaactgtgcaacagtagaagtgtgcgcaaggagaaaagtgtt

SEQ ID NO: 437 - DNA, 300 bp, Homo Sapiens
  allele 156: 10-154-156 : polymorphic base C or T
  misc_binding 137..155: 10-154-156.mis1
  misc_binding 157..176: 10-154-156.mis2, potential complement
  primer_bind 1..19: upstream amplification primer
  primer_bind 283..300: downstream amplification primer, complement
  misc_binding 144..168: 10-154-156 potential probe
gtttatgttagtattccccttttgtttacattgcctgataacttgtttccctttgtctcccccaagggaagcattcatttataatgaatttttcagctcagtgtgtttcagcaaacacttattgacacccacaaaccctgacactgtgccgtctcyaggggaaacaaaagtgagagtcctgctgggtgtgtagtccctgcctaggacgggctcacattagtgggggatacacacatacaaatgctcacactgcagtattaactgtgcaacagtagaagtgtgcgcaaggagaaaagtgtt

SEQ ID NO: 438 - DNA, 300 bp, Homo Sapiens
  allele 226: 10-154-226 : polymorphic base A or G
  misc_binding 206..225: 10-154-226.mis1, potential
  misc_binding 227..246: 10-154-226.mis2, potential complement
  primer_bind 1..19: upstream amplification primer
  primer_bind 283..300: downstream amplification primer, complement
  misc_binding 214..238: 10-154-226 potential probe
gtttatgttagtattccccttttgtttacattgcctgataacttgtttccctttgtctcccccaagggaagcattcatttataatgaatttttcagctcagtgtgtttcagcaaacacttattgacacccacaaaccctgacactgtgccgtctccaggggaaacaaaagtgagagtcctgctgggtgtgtagtccctgcctaggacgggctcacattagtggggratacacacatacaaatgctcacactgcagtattaactgtgcaacagtagaagtgtgcgcaaggagaaaagtgtt

SEQ ID NO: 439 - DNA, 900 bp, Homo Sapiens
  allele 501: 12-776-259 : polymorphic base A or G
  misc_binding 481..500: 12-776-259.mis1, potential
  misc_binding 502..521: 12-776-259.mis2, potential complement
  primer_bind 243..263: upstream amplification primer
  primer_bind 674..692: downstream amplification primer, complement
  misc_binding 489..513: 12-776-259 potential probe
gagccactggggagcccactgccttcggagctgtgcctcagctctccagcctctcctcgccaagctcagctcacctggctccccctgcgcaccttcacccctcccggggccacaaagacacacagacacacacagacacacacacacacacacagacacacacacacacacacacacacacacacacacacactcttaccgccccagttgcaaagtctctcccaaagtggttcagcagctgcttatggctctctccttgtgtccccacaatggtcagtgagatggagtcccgtgttcccgacaagaggtcggtgcctgtggccaccctgactttgtaggtggccatggctgctcttcaggaggcaagaggggcactcagtcccagacaccgtggaggggccacacgaaggcccaaggcaggcaagagaagccaggcacagagtggagtggacagggctggcctccgaggtgcagtggtgaggtggcgaggtggggtgactrggcctgccagccaaattctggaaaagctgctgcccttggtggccggggtgggtgccgggcaggcccaggcggagcccagctggtggtgagtgagcaggtgtctgggctccaagccttctgggagctggtggggaggaagagcaggcagggcactgggcctgcctctgaaagggcggatagaagatgccgtggatgaaggcgccttcagggtgggggagccagtccagcctgagccagggccctagggaagttgcgggagggggcagggtgtggtccccagatctttatcagactaataagctccttcctcctgccagtccccattggctacagtgccaggcacccctactaagcagggccatgggcagtgagtgacttgcattggttctgaggccactg

SEQ ID NO: 440 - DNA, 1001 bp, Homo Sapiens
  allele 501: 10-384-109 : polymorphic base C or T
  misc_binding 481..500: 10-384-109.mis1, potential
  misc_binding 502..521: 10-384-109.mis2, potential complement
  primer_bind 393..412: upstream amplification primer
  primer_bind 802..819: downstream amplification primer, complement
  misc_binding 489..513: 10-384-109 potential probe
  misc_feature 328: n=a, g, c or t
taggtctgagaatcggcataagacagattcatgggcgaaagcctacagatttctttaatacaagttgtacgtggcatgggagccctcttaaaaagatgaagaccccaagaagcagttagagtcaatcccccttagatactgcattgaatgaatcatcgtgagatgtgataaggccaaggggcttgggctagggcaggtaactgggcagggaagtgactcgggaggtaagcgttcattgtacaagatctgtttgtatggatttcctttggcttcaacttcccaaccttgatgaaaagagtgttactttccttttggtatagtgaggacntctttcataggggactttcatctcctgcttctaagaaacagcacgaatgtcagagtatcttgcacctgctgtttttttaagtgcttttcattcaacgtagtccctgtgccacagcagcataccttggggtgacaaattcttaacacctccagaacaaaggctcaggagaccaygcatggcctgattgcctgttctccttcccaggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcggtgagcagctcaggccccttctgccccgggcttcccaagaaccgaaagttcttcctgtcctcaaagcactgtagtcataggaggaatgacactgctgtgcaggggcgggaagtgggagggctctgccctgtgcctcgacacacctgcaggaggcatgactttccttgggattcttacaagcccctgagggtggagcgggtggccccaggcctcactgtcgtcatgtcctcactctgcgctacagttctacaggggagggttgtgcccctc

SEQ ID NO: 441 - DNA, 1001 bp, Homo Sapiens
  allele 501: 12-296-388 : polymorphic base A or G
  misc_binding 482..500: 12-296-388.mis1
  misc_binding 502..521: 12-296-388.mis2, potential complement
  primer_bind 114..134: upstream amplification primer
  primer_bind 543..563: downstream amplification primer, complement
  misc_binding 489..513: 12-296-388 potential probe
  misc_feature 306,378: n=a, g, c or t
catgacacatgtatacatatgtaacaaacctgcacgttgtgcacatgtatcctagaacttaaagtagaattaaaaaaaaaaaaagaaaattcactaattaggtgtgtgaccttgggtaaagttcaagagcaaagctacacaacttccctaagcctcagtttcttcatcattaattggggaagtgctctgaggctcaaatgaggtcatgcacataaagcactcggcatgggcagggcatctgagggaagcctgaacacttggcattgggcattgttattgttcttcctcaggctcctctcatgttgntctttctttacagcaaagttggcccgagatgaccaaattcacattctcaagcaacaccgacgtaaagaactngaaacacggcaaaaacaatatcggtgagttatgacatcagatcgagtggccacggggccatggtttcttctatctcaagagcatggtatgaaataaaccctttccacagtgtatggcctgtcrctgctggaaagtcaccaaggcaccagctcccagtgtgggtgcacaatccccaaacttcaccttacctacaactccagacaagagatggagaggagagtaatgaaaataactttggatcaaccatattggcatgtaggaagaatgggcagaaaagcttgagtgtaccttaatgttctccattgtaggggttgcctcttacttcttatgtcttcttataacaattcaattataaaagtgatacatgatcagcaataaaattgacaactcttcagccaactgaccagaggattcaaaccattaaaatgagcaataagagaaaatcaatacagaaattaaaatgaataaaaaaggaaaaatgagactcataaaatgagggaaaatcaatacagaaattaaaattaataaaaaagaatactatgaacaattgcatgccaacaaactagttaaatgaaatgcgcaaattcctagaaagacgcaaactgccaaaactgactcatgaa

SEQ ID NO: 442 - DNA, 1001 bp, Homo Sapiens
  allele 501: 10-388-379 : polymorphic base C or T
  misc_binding 481..500: 10-388-379.mis1, potential
  misc_binding 502..521: 10-388-379.mis2, potential complement
  primer_bind 123..141: upstream amplification primer
  primer_bind 542..561: downstream amplification primer, complement
  misc_binding 489..513: 10-388-379 potential probe
agggccagctcaggtatgatgagttggtgccacagcctgacccagtgatgggcagggggcagcagttggagctgtgcccatccagggagcactcgggagaggagaccaagcagggactctgctcttaggtgaggtcaggagggccatggccctggctgccctctactcagagctcagggtgggcctcgcttttctcctggtagagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccaggtaggggttgatgggctggggaagtggccaaggtcacagtctgtcaggtggaagccagttcctcctggccagtgctcataggccaccaagacgctaactgcaggcccatctggcctacagcagcygcttccttttcctggcagcagtgtcagccagggtcctgggcattatgcagactgtcttgtgcaacatcagaggaggaattgcggggaatgtttctccatgatgctcgagtctgggaacataatgtcaatattttcactatcagtatcaataattacaggagctacccttgattaggggcctgtggtgggacaggcattgtgacaggtgctttacacacaaggtcatcagttgtcacccaccttgcaaaggggagaacactggagaaagaagcagaccttgtgtgagaataaaaaaggggcacgaggagaaacccaacagaatggttgattttctcgttagaaatgctgctgcccatgctcctgtcgcaccctcctccccaccctcacctgcagactcagctgcctccggctgcaaggctgacctagtcttgagacagaagaagttcaaaccaactccacctggatctggtggggctcagcaacaggcgctggcccatcag

SEQ ID NO: 443 - DNA, 1001 bp, Homo Sapiens
  allele 501: 10-389-116 : polymorphic base A or G
  misc_binding 481..500: 10-389-116.mis1, potential
  misc_binding 502..521: 10-389-116.mis2, potential complement
  primer_bind 386..403: upstream amplification primer
  primer_bind 792..809: downstream amplification primer, complement
  misc_binding 489..513: 10-389-116 potential probe
acccccctcaacccctgtagagtcccctgcccgtgcagaatcccctcccccttcccccgcagcccccctaccccacccggcggacagccccgcctcgcttcctgtctcttcctcccaagggagacccctgtcctggctctgactggggttgagttcgccagttttgacttatgtgtagagtccggcagcatcattttttggcatttaactcgtcacatctatttcacctaacctctttcttcttagtaaactgacactcgggtcggtctctcatctttcgtgccagtcaagcaggtttcagacaccacaaatgccgaatgagctgctgccattccttcatcttaccccgaactgccacaacctgtgaacaccttccatgtgaatcaatcagccttggagtcagaggagagaagtacacattctgagctccgctgagtcgcaggaaagggagaggggtgcccagaggtcatcactctttccccaggcctgatttttggtccrtctgctgagcctgatttggacacatctctctgcctcctgcagcaagggaacattttcatcgtggactttgagctgctggatggcatcgatgccaacaaaacagacccctgcacactccagttcctggccgctcccatctgcttgctgtataagaacctggccaacaagattgtccccattgccatccaggtaggctgctggggggcacacctttctgagcagctcagtcctctgcgatccagggctcctgggtggctccattcacactccagctgaggaagctatgtcttgaaagacactagggcttcctgcaggccctgaggtgggctgtccataggggcggagagggttctactccccaaggcacacttgagaagcccctggccagtcgaggcacactgtggaggacctgccctgggatcatattctgcactctccaccccagcaccctgaccaagggcccccagtcaaggtgctgccaggggccaggcaggtgaagc

SEQ ID NO: 444 - DNA, 1001 bp, Homo Sapiens
  allele 501: 10-389-349 : polymorphic base C or T
  misc_binding 481..500: 10-389-349.mis1, potential
  misc_binding 502..521: 10-389-349.mis2, potential complement
  primer_bind 153..170: upstream amplification primer
  primer_bind 559..576: downstream amplification primer, complement
  misc_binding 489..513: 10-389-349 potential probe
tctttcttcttagtaaactgacactcgggtcggtctctcatctttcgtgccagtcaagcaggtttcagacaccacaaatgccgaatgagctgctgccattccttcatcttaccccgaactgccacaacctgtgaacaccttccatgtgaatcaatcagccttggagtcagaggagagaagtacacattctgagctccgctgagtcgcaggaaagggagaggggtgcccagaggtcatcactctttccccaggcctgatttttggtccgtctgctgagcctgatttggacacatctctctgcctcctgcagcaagggaacattttcatcgtggactttgagctgctggatggcatcgatgccaacaaaacagacccctgcacactccagttcctggccgctcccatctgcttgctgtataagaacctggccaacaagattgtccccattgccatccaggtaggctgctggggggcacacctttctgagcagctcagtcctcygcgatccagggctcctgggtggctccattcacactccagctgaggaagctatgtcttgaaagacactagggcttcctgcaggccctgaggtgggctgtccataggggcggagagggttctactccccaaggcacacttgagaagcccctggccagtcgaggcacactgtggaggacctgccctgggatcatattctgcactctccaccccagcaccctgaccaagggcccccagtcaaggtgctgccaggggccaggcaggtgaagctgtggactaagctggagaccaagaccactgaggggcaccatgggttctggggtcaggaaccaggccagtcctggtatgccacctttgatgatgatgtgagttcttatgtccaccggagatgaggcaggaggaagagggagaccctggaggaaaggcaggcgggcacagggctttgtctccccctgttcctggcaccagcctgctgccaggctgggagctggtgtgcagacagc

SEQ ID NO: 445 - DNA, 928 bp, Homo Sapiens
  allele 501: 10-391-94 : polymorphic base A or G
  misc_binding 481..500: 10-391-94.mis1, potential
  misc_binding 502..521: 10-391-94.mis2, potential complement
  primer_bind 409..426: upstream amplification primer
  primer_bind 821..838: downstream amplification primer, complement
  misc_binding 489..513: 10-391-94 potential probe
cctggagagatgttctcagagtcagtaatgcccctaaaggaagaaaacagctaggagcctgctgttccccaggacacgcggctggggcatgggcctgacacacgggcctcgctggccagccagtagagttggaaaaggcaaatgagttcatggtgatcctcggctgatgctgatggccgcccctgccatcactctccgtccctgttctcgaatcctacaagcattggctgctggggtgactgcatgctaaaagtacccatgtgcctcagtttcctcaccagtaaaacaggtcaaatagtacagctgccttacagaatgatggtcagattaagacagtgaactcagggagcaaagaggtaagcattgtacaagtgctggccaggaccctctgaatcattatcatgcttagtaagcatcagaggggtgcaggcctccagcacttattcagcagaaagatcagcacccagccttcacttcctccctgcgcccagcatcatcctrtagggcaggcctgggtgggggagctgcgggtccctgaggcaccaggtcacctgactgggccccctctgaggcctcctcctctcccctccccagctgctggtggcacacgtgagattcaccattgcaatcaacaccaaggcccgtgagcagctcatctgcgagtgtggcctctttgacaaggtgggtgccctcctaccctacttgttgcctggaagagcccagcctggccgccttcactccctatctgagatctagacaccctttcaggaggcctggaagggtgaaggctggagtctgctcagagcactggctccagcatcctcctgatgtctccagcccgtgccattcagccaggagcactcctccaggcgcaccaccaggtcttccttctcactgatggctcctggtcccctcctcccacccctcc

SEQ ID NO: 446 - DNA, 1001 bp, Homo Sapiens
  allele 501: 12-277-147 : polymorphic base A or T
  misc_binding 482..500: 12-277-147.mis1
  misc_binding 502..521: 12-277-147.mis2, potential complement
  primer_bind 355..374: upstream amplification primer
  primer_bind 783..803: downstream amplification primer, complement
  misc_binding 489..513: 12-277-147 potential probe
  misc_feature 468: n=a, g, c or t
gcaccagcctgctgccaggctgggagctggtgtgcagacagcaggggccaaggccaggactggactgggcataggtccctgggagtagggaggaactgcgcagaggacaccgtgggagactggcagatgagcattcagcaaataatgtccatgaactggaccttgggagctgtggacacaatagcagctggataggtcaggcaccagccacatgccaaggctatcctatgggttaacctgcacagtccgcaatcccttaccctcgattctaaatctaaaaaatctgaaaactgctgcatatttcaaaactgtgcagcaaattcattgtttgtaaacaaaccttctttgaagcaataggtgaggttatttagaggctttttccattcaatgtgatatgtatgtggatcactgcagaaatactgctctgttcgattgtaaaatagtatgttgccctagactgggggtggnagggggtatggcacataatgaagtatacccacwgctaaaatcctaaaaattctggattctgaagcacatttgaccactggggttttagataacctatctttatttgtgtaatcatcaccacaaccatcctaggtagtgggctctattgatgttgatcattttacccagataagaaaactgagacacaggtgcccacagccagccacagagctaggattcaagccaggtcatctgactctagattccagcctccccacagtctcccaggggcacgtagcctcagaggagcttcctgtctgttaccagagagaagccctgtgcctaagaaactgaagcagcaggtaaagggacaggtgacctaaaagaagacaaaattgctgggagatccccggagatcccaggcaccactgatggtgccttcaaaagcttggctcagagatctcttggagcagcctggagtcaggggcctagcttaaattccagttcagccacttgctagcaggctgtgggaccttgagcaagccacagaatgt

SEQ ID NO: 447 - DNA, 1001 bp, Homo Sapiens
  allele 501: 12-278-413 : polymorphic base A or G
  misc_binding 482..500: 12-278-413.mis1
  misc_binding 502..521: 12-278-413.mis2, potential complement
  primer_bind 90..109: upstream amplification primer
  primer_bind 600..620: downstream amplification primer, complement
  misc_binding 489..513: 12-278-413 potential probe
gcagggccctttaccccctccaggctcttctgattccaaagtcactgttaaagaaattcagatacttctggaacttcccaagaggcgaagttctccaacaactatactctgaagtgaaatatagcagtgtgtttcctttcccccaatgtatcagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaaggtacagccagctaccgccccacctgctatgggagggcatctgagatgtggagtgggagggatcactgacatcccacagggggacctgtggctgggagtgggtggcagaaagggagccctggagagatgttctcagagtcagtratgcccctaaaggaagaaaacagctaggagcctgctgttccccaggacacgcggctggggcatgggcctgacacacgggcctcgctggccagccagtagagttggaaaaggcaaatgagttcatggtgatcctcggctgatgctgatggccgcccctgccatcactctccgtccctgttctcgaatcctacaagcattggctgctggggtgactgcatgctaaaagtacccatgtgcctcagtttcctcaccagtaaaacaggtcaaatagtacagctgccttacagaatgatggtcagattaagacagtgaactcagggagcaaagaggtaagcattgtacaagtgctggccaggaccctctgaatcattatcatgcttagtaagcatcagaggggtgcaggcctccagcacttattcagcagaaagatcagcacccagccttcacttcctccctgcgcccagcatcatcctgtagggcaggcctgggtgggggagctg

SEQ ID NO: 448 - DNA, 1001 bp, Homo Sapiens
  allele 501: 12-288-190 : polymorphic base G or A
  misc_binding 481..500: 12-288-190.mis1, potential
  misc_binding 502..521: 12-288-190.mis2, potential complement
  primer_bind 670..690: upstream amplification primer, complement
  primer_bind 199..219: downstream amplification primer
  misc_binding 489..513: 12-288-190 potential probe
tttaactagcaatttaattcaatcatattattcacacattcattcactgggaatgaaagccctctgtccagagaacaagtaatctgagtttcattcattagtcaagaatgtacttataggtaaacacagggcactgctgtgagtcccaattttaaggccaagctactggtgacttactattaaattttagtgtagtctactaagttcaaacaaagacaccataggccttggattatctgtacagaaagccaattataaccactgctacattacttactacctcacaaggaatggctggtttgacaccatctggaaatctacagagaagttcacaagtactaagagaagccaataaatcatatcctcagacctttttgacattaattattcaacagagaatggatattggggtgagggagaactacctgctaacttaacattataaacccagattgagagctaaagctgttccttaccctttaagaaataaatttgataatrcaagcttttattttgttttcttgttagaacaattcatattttacattggtaaaaccaaacaaataacaagccctagaaaacacaggggttttaaagcctgaaacctgtcaatatttagggttgcttctccactacttggtaggatcttaacagttcagttccagcagaccagatcatcttttattttcccccaataaacactgctctttttcttcttcttcttcttcttctttttttttttcttttttgatacgtagtctcgctctgtcgcccaggctggagtgcactggtgcaatctcggctcactgcacgctccgcctcccaggttcatgccactctcctgcctcagcctcccaagtagctgggactacaggcgcccaccaccatgtccggctcagtttttgtatttttagtagagacggggtttcactgtgttagccaggatggtctcgatctcctgacctcgtgatctgcccgcctcggcctcccaaagtgctggg

SEQ ID NO: 449 - DNA, 1001 bp, Homo Sapiens
  allele 501: 12-289-35 : polymorphic base A or G
  misc_binding 481..500: 12-289-35.mis1, potential
  misc_binding 502..521: 12-289-35.mis2, potential complement
  primer_bind 467..486: upstream amplification primer
  primer_bind 915..935: downstream amplification primer, complement
  misc_binding 489..513: 12-289-35 potential probe
accggcacgctcgttgcgtgtcgaggtgtgttgactcctacagcaaagggcacggatccgcgggtcagcaagcccgacgaatttacaccaatgacccgccgtgtcgccagtctcagaccagggcacaacacgccaaccctgcagaccacccccacctccccagccactgcagacccttccccctctgcttctgcagcacctctcccgaaacacgctcattcccgcccccgcagaccttccctacctcctggagacccccctcaacccctgtagagtcccctgcccgtgcagaatcccctcccccttcccccgcagcccccctaccccacccggcggacagccccgcctcgcttcctgtctcttcctcccaagggagacccctgtcctggctctgactggggttgagttcgccagttttgacttatgtgtagagtccggcagcatcattttttggcatttaactcgtcacatctatttcacctaacctctttcttcttagtraactgacactcgggtcggtctctcatctttcgtgccagtcaagcaggtttcagacaccacaaatgccgaatgagctgctgccattccttcatcttaccccgaactgccacaacctgtgaacaccttccatgtgaatcaatcagccttggagtcagaggagagaagtacacattctgagctccgctgagtcgcaggaaagggagaggggtgcccagaggtcatcactctttccccaggcctgatttttggtccgtctgctgagcctgatttggacacatctctctgcctcctgcagcaagggaacattttcatcgtggactttgagctgctggatggcatcgatgccaacaaaacagacccctgcacactccagttcctggccgctcccatctgcttgctgtataagaacctggccaacaagattgtccccattgccatccaggtaggctgctggggggcacacctttctgagcagctcagtcctctgcgatccagggctc

SEQ ID NO: 450 - DNA, 1001 bp, Homo Sapiens
  allele 501: 12-296-119 : polymorphic base A or G
  misc_binding 481..500: 12-296-119.mis1, potential
  misc_binding 502..521: 12-296-119.mis2, potential complement
  primer_bind 383..403: upstream amplification primer
  primer_bind 812..832: downstream amplification primer, complement
  misc_binding 489..513: 12-296-119 potential probe
  misc_feature 575,647: n=a, g, c or t
tatgcagccataaaaaaggatgaattcatgtcctttgtagggacatggatgaagctggaaatcacccttctcagcaaactatcgcaaggacaaaaaaacaaacactacatgttctcactcataggtgggaattgaacaatgagaacacttggacacaggaaggggaacatcacacaccaaggtctgtcatggggtgggggtaagggggagggatagcattaggagatataactaatgtaaatgacgagttaatgggtgcagcacaccaacatgacacatgtatacatatgtaacaaacctgcacgttgtgcacatgtatcctagaacttaaagtagaattaaaaaaaaaaaaagaaaattcactaattaggtgtgtgaccttgggtaaagttcaagagcaaagctacacaacttccctaagcctcagtttcttcatcattaattggggaagtgctctgaggctcaaatgaggtcatgcacataaagcactcggcatgggcrgggcatctgagggaagcctgaacacttggcattgggcattgttattgttcttcctcaggctcctctcatgttgntctttctttacagcaaagttggcccgagatgaccaaattcacattctcaagcaacaccgacgtaaagaactngaaacacggcaaaaacaatatcggtgagttatgacatcagatcgagtggccacggggccatggtttcttctatctcaagagcatggtatgaaataaaccctttccacagtgtatggcctgtcactgctggaaagtcaccaaggcaccagctcccagtgtgggtgcacaatccccaaacttcaccttacctacaactccagacaagagatggagaggagagtaatgaaaataactttggatcaaccatattggcatgtaggaagaatgggcagaaaagcttgagtgtaccttaatgttctccattgtaggggttgcctcttacttcttatgtcttcttataacaattcaattata

SEQ ID NO: 451 - DNA, 1001 bp, Homo Sapiens
  allele 501: 12-297-291 : polymorphic base C or T
  misc_binding 481..500: 12-297-291.mis1, potential
  misc_binding 502..521: 12-297-291.mis2, potential complement
  primer_bind 211..229: upstream amplification primer
  primer_bind 688..707: downstream amplification primer, complement
  misc_binding 489..513: 12-297-291 potential probe
ctcagtttctatctgtaaagcaggataatcactcgctcggccattcccaggcccagtgcttcctgagggcctgttggggggtgtccactgttgatagtgcccaccataattcagtgtgtcacctgagaatttaatgtgtcacagcaaatagacaaatatagcatcagcccagtgtacttggcccagagaggagggaggaaggtggccattgtagttccacaaaccttccgaagatattttgcagtttgacacatgtgaccctggtattttcctggaaggaggcctttatctgtcattcttccattagtggcccctgggatgttagaaccacagccatcaagctttgtcttttactccctgagttgggtcaaggctggagccctctgccccttgttcacctcttatcatattcaggcttgaagccagcaccaggaaagtggctgggctggccatagaccagccagactgcaggcctggccccctcctgctgtggaagtcccygtcagatggcagatggagtccttgtaaatctgcctagtgatttcaccccaagtgaaactcaggggctctccaccaggtgcctgcaggtgtaggtagggcagggggccaggagtgtcccagtcccctgtgactgcaccacaggtgtgctggagggtcaccccactgtccactccctcagagaagctgctcagtctcttcgtgtgggtcgtcacccccaggtagacatcgggccctccctgtgggacctgcccagtcctggaatgcctcctcagcccatctccctcccctcttagtccaaggtactgggagcctccctcccatgagagtgtccctgttagctcctcccaccccaccccagctttcctgtcatctatcccctggggacaccttcctccctctccagcccctcagagccataggaaagctacttcccctgcagcagccacactcagaccaggcccgggcctctggtggccgcccctcagtcctcaccgcacaca

SEQ ID NO: 452 - DNA, 1001 bp, Homo Sapiens
  allele 501: 12-298-105 : polymorphic base G or A
  misc_binding 481..500: 12-298-105.mis1, potential
  misc_binding 502..521: 12-298-105.mis2, potential complement
  primer_bind 586..605: upstream amplification primer, complement
  primer_bind 33..53: downstream amplification primer
  misc_binding 489..513: 12-298-105 potential probe
ggacaacatcagagatattttccagaaagcaagtcccaaaactcattcaaatcagtcattctttccacacttatttactatgcaactactatgtgtgaacaactgtgtcaggcatagaatatggaccaaaatctcactcctaaccatatgccaatgataatattgagaatcccttatttgaaatgcttgggaccagaactgtttcatatttctgagttttttggactttggaatatttgcattatacttacaggtggagcatcccaaatctgagaattcaaaatctgaaaggtgacaatgagcacttactttgagtgtcatgctgacattccaaagtttcagattttgaagcatgctggatttcgagtttgtggattagggacgctcaacgtgtattaccactgaactcctctgaaaaagtgttttggtgagaaatgtccaaactagggaagagcttaagaatgacataaaagaagcacatacataaagtatatcaaggtrgaagtgtgacaccactctgccctgtagtcagaatggcatcttggttctgaatgagaagtaaagtttgccaagcatcaatgtaaagaagtggaattagacataccaaggagaaaaaagttccagttcaagcccaaactaagcttcaatgcccaagtaataaaaaccctggcaaattatttacagctctttaacacattcagtcactgcttactggataccaccaccttgtgaccccaggagagatggaagcctcgctgcatcttccttccttcctcagagaaggtactaagagatgccacacactaccctggctttcatctccacatctctctggtgggctcttttcatctacattcaacatgagagctcctcagaacacagcctcatgccctctagatttcatttgttttctcctttagccagtgcttttccaactctggacacctaatcatttagggatcttgctaaaatgtagattgtggtttgttaggtctaggggg

SEQ ID NO: 453 - DNA, 1001 bp, Homo Sapiens
  allele 501: 12-300-126 : polymorphic base A or G
  misc_binding 481..500: 12-300-126.mis1, potential
  misc_binding 502..521: 12-300-126.mis2, potential complement
  primer_bind 376..395: upstream amplification primer
  primer_bind 840..860: downstream amplification primer, complement
  misc_binding 489..513: 12-300-126 potential probe
cttctagctgcaaggctagcctcaccctgccaccagtaatgccacaggtgcagcagagctgcttggtctcactgttctctgggcatcaccatgcagctgtgaactgcaaatgtcccaggacgactcgaatccatgcaagctccctgtatctaagcctcaccattttcactcacttattatccccactgaaaactggaaagagaggaagtggctatgatggaaagacctggggtgtgactccagctctgctggcaagtggcagaggtgggagtcactgagcctcgctgtcttcatctgtggaaggggtggtaactcccctgcactcccagagtcattgtggggatccactgtcagcaagcccatctccagttgtaaaggtctcccacaaggctatcccatgtgggggcagctgcggaccctcactgggcacagcctcgcaggtgcaggcatgagcctgggcatctccccatcctccagcctgagctaagtgcagtcagcagrcgttgccctctgagcagcacagcaccatcctggctcactggattctctctcctcaagggcagggcccaggatttgtccatttctttcacctgcctgggtcgtagcactgagccttgtcaggggcaggccttcagtgaatgtcttggctaaatgaattcaggagttcatttaaggtgttcatgaagaatcttggctccatgaactgtagtggaggcaaaactccacctcttcccatttcagctaggtctgagaatcggcataagacagattcatgggcgaaagcctacagatttctttaatacaagttgtacgtggcatgggagccctcttaaaaagatgaagaccccaagaagcagttagagtcaatcccccttagatactgcattgaatgaatcatcgtgagatgtgataaggccaaggggcttgggctagggcaggtaactgggcagggaagtgactcgggaggtaagcgttcattgtacaagatctgtttgtatgga

SEQ ID NO: 454 - DNA, 1001 bp, Homo Sapiens
  allele 501: 12-300-410 : polymorphic base A or C
  misc_binding 481..500: 12-300-410.mis1, potential
  misc_binding 502..521: 12-300-410.mis2, potential complement
  primer_bind 92..111: upstream amplification primer
  primer_bind 556..576: downstream amplification primer, complement
  misc_binding 489..513: 12-300-410 potential probe
  misc_feature 786: n=a, g, c or t
ctgtcttcatctgtggaaggggtggtaactcccctgcactcccagagtcattgtggggatccactgtcagcaagcccatctccagttgtaaaggtctcccacaaggctatcccatgtgggggcagctgcggaccctcactgggcacagcctcgcaggtgcaggcatgagcctgggcatctccccatcctccagcctgagctaagtgcagtcagcaggcgttgccctctgagcagcacagcaccatcctggctcactggattctctctcctcaagggcagggcccaggatttgtccatttctttcacctgcctgggtcgtagcactgagccttgtcaggggcaggccttcagtgaatgtcttggctaaatgaattcaggagttcatttaaggtgttcatgaagaatcttggctccatgaactgtagtggaggcaaaactccacctcttcccatttcagctaggtctgagaatcggcataagacagattcatgggcgaaagcmtacagatttctttaatacaagttgtacgtggcatgggagccctcttaaaaagatgaagaccccaagaagcagttagagtcaatcccccttagatactgcattgaatgaatcatcgtgagatgtgataaggccaaggggcttgggctagggcaggtaactgggcagggaagtgactcgggaggtaagcgttcattgtacaagatctgtttgtatggatttcctttggcttcaacttcccaaccttgatgaaaagagtgttactttccttttggtatagtgaggacntctttcataggggactttcatctcctgcttctaagaaacagcacgaatgtcagagtatcttgcacctgctgtttttttaagtgcttttcattcaacgtagtccctgtgccacagcagcataccttggggtgacaaattcttaacacctccagaacaaaggctcaggagaccacgcatggcctgattgcctgttctccttcccaggtggattcata

SEQ ID NO: 455 - DNA, 1001 bp, Homo Sapiens
  allele 501: 12-301-379 : polymorphic base A or T
  misc_binding 481..500: 12-301-379.mis1, potential
  misc_binding 502..521: 12-301-379.mis2, potential complement
  primer_bind 124..142: upstream amplification primer
  primer_bind 553..573: downstream amplification primer, complement
  misc_binding 489..513: 12-301-379 potential probe
  misc_feature 892: n=a, g, c or t
gaaagtggaaggaatcattctacatggacagtgaagttacctgggctgtggaggggcctttgggagccaatattgtgatacttttctacatatccctcaatagttgaacttcttacaaggaatatgtagtatatctgggttgtttttttaactcaaaaaagtaaaagaaggaaaataatatagagccagaaaaatacctattttctgtatgaattatgaattttatgaactttttcataaaaattcatgtttaattgttttcactttgtcttattcactttttaaaatttgggattgtgctatatataccactttgcatcctccttgctgccctttagcagtgtagcaaaaatcattttcccatattttcaaaatctcatcataaacattattctagtttctatgtactattccattggatggatgcctcatcattcacttaaacacccagcttccctggacatttaggaggtttctaatttttgtattcttataagcaawgtgaaaacccttgtatgtgaaatttgtatacattattaagtattttcctaggacagatgcccagatatgaaattaccaaatagtaaaagttattagtatacattgacaaatttctcctcaaaaatctttaaccatttgggaggctgaggtgggtggatcaccaggtcaggagatcgagaccatcctggctaacacggtgaaaccccgtctctactaaaaaatacaaaaaattagccgggcgtggtggcgggcgcctgtagtcccagctgctcgggaggctgaggcaagagaatggcgtgaacctgggaggcggagcttgcagtgagccgagattgcaccactgcactccagcctgggcgacagagcgagactccgtctcaaaaaaaaaaanaaaaaaaatctttaaccagttttcacgagccatgtatgggtccctgtttcatcaaacacttgccataactgagcaatatcttcatttttcttaatttttctaagttgca

SEQ ID NO: 456 - DNA, 1001 bp, Homo Sapiens
  allele 501: 12-302-264 : polymorphic base G or A
  misc_binding 481..500: 12-302-264.mis1, potential
  misc_binding 502..521: 12-302-264.mis2, potential complement
  primer_bind 745..764: upstream amplification primer, complement
  primer_bind 286..306: downstream amplification primer
  misc_binding 489..513: 12-302-264 potential probe
  misc_feature 621: n=a, g, c or t
cacagaaaatgaggggcgtgggtaatagaggaggctgggcagtaacctggcagaaggcgccagaggccaaggaaggtgcgctggtgtcctgcagtgagaaggatgtgtgcactatcaactgggtaaacacactgctatagctgctccagcgacagcaggcactctcagaagggaactgagaaaaggggaatgccagtttctgccaaggatatatggaaaagttttttttccccgtatgttctttggcaaccttgttaaaatcatttaaaatggtgaatttgataacaaagccagccactaaaagacttggatgtagcaaaacaaattgtcaaaaagtatttatcatttctaagaaataaaataaactgggatttaggcttggatagaaatccagaggtttgttttggcataattaattacaacatctgaagaagggaggatttttacaagaatttttttttttgtagtgagattgctttatattccttttcatgactggaragtctgtcatttggcaacccgcaaagaacttcaggaacagagggcctaagttttcttgacacatttggatttttgcatgatgaacatttgcacttttattagtaattgtcgagtcgtgtntggtctgatcctatggagaggagagtgtaggtgttctctggagctagtactgcccccggctcacacgtgccacactgcctgctgctttcagaaagagcaggacggctggtcctgtcccatctagtgaggtcctgtcccatctagtaaggttctgtcctgcagagctcctaagaggggattgctggcctttgattacactggcttccagaatctgaccatggaaccattatttgaagctgtcagcttcattttgttgttgatcaggccagtcttttaggtctttgttggttgatagatttctctcaggtctatagcagcaacaaataaagctctttaaaattattttcttgaccattctgcctatggattggttctgacct

SEQ ID NO: 457 - DNA, 1001 bp, Homo Sapiens
  allele 501: 12-309-405 : polymorphic base G or A
  misc_binding 481..500: 12-309-405.mis1, potential
  misc_binding 502..521: 12-309-405.mis2, potential complement
  primer_bind 884..904: upstream amplification primer, complement
  primer_bind 456..475: downstream amplification primer
  misc_binding 489..513: 12-309-405 potential probe
gtgaggagatgctgttggatggctgattcacttcccaagccctcctttccctagctgccttccagctagaggtggcctgtgatccagttctggccagggagatgtaagcagatttcaggcggccaggtgggacttgtgggacaacttttgccttcctgctgaaaatggtgactctcagctaacagacctgttaatccttgatcagtcctctaattcctgccaaggccacaaccgcaatgcctgaaggtccagctctcatcgtgagaccatgtgtcaagtaggagatagcacagagaggaaagagcctgggtccctggcaacatctgttacagggagccgaagacccatgggacgtgaccaactcagcattcccctggagactatatgatcaaacagcaaaccgttcatcatgaatgcaggatatgagcaaactcacgactgctccggccgactgctcctgccaacagaaggtttgctggaggcaatcactccctggcgccraggttctctactgcaacatctagaaccttttgttcaaggaatgcagtcttgcaagcctactctagactgagcagctgaccccttcttccacccgccttctcactatctcttttgcctaataaatatggagggctgtgtaaagctcagggcccttgtccactagagccaagatgcctccttcttccaaatatactcttttgtctcttgtcttttattcccgccttcaccccttgttcagttcccctaggtccatgcgggttacacagtggcaccccgaacagccacagaatcgggtgcactacaatctgtgatcaactctgccctggatcacctgcttccagacaccttgtcaaatgaaccatataaatccataattatgtaagtcatcatagttagctttctgttactttcagtcaaatatattcctaattgtggcaacagactctcctgtgcctgagatttcttctgccttaaagtatatggttttctggaaaaaatgg

SEQ ID NO: 458 - DNA, 1001 bp, Homo Sapiens
  allele 501: 12-310-105 : polymorphic base G or C
  misc_binding 481..500: 12-310-105.mis1, potential
  misc_binding 502..521: 12-310-105.mis2, potential complement
  primer_bind 397..415: upstream amplification primer
  primer_bind 826..845: downstream amplification primer, complement
  misc_binding 489..513: 12-310-105 potential probe
ttgggaggccaaggtgggaggatcatttgaggtcagaattcaagaccagcctggccaacacggtgaaaccccatctctactgaaaatacaaaaattagccaggcatggtagcaggtacctgtaatcccagctactcaggaggctgaggcaggaaaattgcatgaacctgggagacagaggttgcagagagtggatatcgcaccactgcactccagcctgggcaatagagcgagactctgtctcaaatagttaataaataaataaattaaattaaataaaaacgcattctctttccccagccccaagtagcagagcccgctctgagcctgggcatggtgacccattctcctcgtgctcacatgcccaactcccagccctccagcccctggcttcggaatcatgtcatcagggtctcccatgtctctggaaggtgcttccagtgtggcaggccatcagctcagtgtctgggtaaaggcttctacagggccagcatggcatagsggggaggtgtgcatgcgttcctgaagccacaaggtcttctgaggagacctgactattggggtggggactagagactgaggtccagccccttaatgccccagactccctgccatccctcggagaatttcccaccacacttatgaatgatcttcgggacaggtgacataaacatacagctatggtagaggcattcagctccatgccactgtgagaatgaacataccaacttttaggcaacaaggccatgtggtcaaggagagaggagaaacgaataggagtaggcaggggtggtgaagcaggtctgacattggcaaaagtgacagagaaggattgggttggaagggcttcagatggcagagaacctctgaaaaagtctcatgccagctaatgaagagtcctcaaagtcaccatcacagaaatcttacatctggcagaaatgacagcaatagtttggcatgaaccccacagtggatccaaacgtgtggcagctgagatcgtca

SEQ ID NO: 459 - DNA, 1001 bp, Homo Sapiens
  allele 501: 12-314-453 : polymorphic base A or T
  misc_binding 482..500: 12-314-453.mis1
  misc_binding 502..521: 12-314-453.mis2, potential complement
  primer_bind 49..67: upstream amplification primer
  primer_bind 536..556: downstream amplification primer, complement
  misc_binding 489..513: 12-314-453 potential probe
gatggcagagaacctctgaaaaagtctcatgccagctaatgaagagtcctcaaagtcaccatcacagaaatcttacatctggcagaaatgacagcaatagtttggcatgaaccccacagtggatccaaacgtgtggcagctgagatcgtcagttaattatgttctctgcagctggtccttctggttccctggagctgggtatctgagtagcacagctccactgctaccacaggagagggagaatcccaaattctgtgcatagactgtctaaacctctggatgacccctaagacacatgtacataaggcaaactgcaaacagcccaatttaggataaaacagcctgtcttactctgtttgtgctgctataataaaatacctcagactgggtcatttatatagaacagaaattgattcctcacagttctggaggctggaagtctaagaggaggcactggcagtttcagtgtctggtaagggagggatcagtgtctgctcccawgaggatgccctctgtgctgtgtcctcacccagcagaagagcaaaaaagggcgaacattctcaaaagcctcttttataaggacatcaatccattcatgagggcagaaccctcaagaattaatcatttctcaaaaggcccctcctcctaatgccatcaccttggggtttaagttccaacacatgatttttggaaggacacatacattcaaatcattgcacaaccaaagtgatatttgaactttcaaatagtttgcagtttgagatcaactaagttaattgcttgcttgaataaaaacatcacagccgggcacgatggctcacgcctgtaattccagcactttgggaagccaaggtgggcagatcacttgaggtcaggagttcgaaaccagcctgaccaacatggtgaaaccccatttctactaaaaatacaaaaattagccaggcggccgggcgtggtggctcatgcctgtaatcccagctctttgggaggccgaggcgggt

SEQ ID NO: 460 - DNA, 1000 bp, Homo Sapiens
  allele 501: 12-316-292 : polymorphic base C or T
  misc_binding 481..500: 12-316-292.mis1, potential
  misc_binding 502..520: 12-316-292.mis2, complement
  primer_bind 210..229: upstream amplification primer
  primer_bind 679..698: downstream amplification primer, complement
  misc_binding 489..513: 12-316-292 potential probe
agtcctgatgcagggggagggggaaggttgtgggagtaatgcagaagtatcctggagacagcacccttggaggagctgcggccctcagtagaaaggttctggggagtgattggcctctccttcctctacacattccctcctttctggtcagagttcccagtggaaaacccattgaggcatctcattccaatcactttcagggacagcacaggttggagggtgagcatagagaagctgtccagcaagttccattctctctactgctgtaaaaccaacctccttggtaactttaaacagccatttaattttgttcatgctcttgcaggtcaggaatttaggaaaggcttcactgggcagttcatctgtggccatgtagcatcagctgaagggggctgggccttcttctgtcatgtgtctggcacctctaggctccttggcctctctgtccatatggagtctcattctttaaggcttctcacagaatggtgtcctctgggtgcytgcatttcttacatgatggctggcttccaagagcaagttttctaagagacagaaagtggaagctgccaatctcttcaggcttgggcctggaaactggcacactgtaacttccatcatattctactggtccaagcagtcacagagcccacccagactccgggggtgggggtggggatgcagacccccccattctcaatggaaggaatgtcaaagaatttgtggcctattattattattattattattattttgggacagagtctcactctattgcccaagctggagggcagtggcacgatctcagcccactgcaacctctgcctcccaggttcaagcgattctcctgcctcagcctcctagggagcttggtttacaggctccaggtagccaccaagcctggctaatttttgtatttttactagagaaagggttttgccatgttggccaggctagtctggaactcctgacctcaggtgatccacccggctcggcctcccaa

SEQ ID NO: 461 - DNA, 1001 bp, Homo Sapiens
  allele 501: 10-281-314 : polymorphic base G or T
  misc_binding 481..500: 10-281-314.mis1, potential
  misc_binding 502..521: 10-281-314.mis2, potential complement
  primer_bind 188..207: upstream amplification primer
  primer_bind 600..617: downstream amplification primer, complement
  misc_binding 489..513: 10-281-314 potential probe
aaagaagccagtttcccatattgctaattttatttacaaaactgatatgtatatgtgtatatatatactttttgtatatgtgttttatatatatacacatatatatgtgtgcatatatatacacatctatacacgttgtgttcatatatatgtgtgtgtatatatatactttttgtatatgtatatactttttgtgttcatagtctgtttattagatagtcaagaatgggaagaaaaggttattttacatatatggtttaagacacatagaagcttttatttatgactagaaatgatttttctccttgattaggtgtctgtccctaaagaactggtggcacttatgagtgctattcgtgatggagaaacacctgacccagaagacccaagcaggaaaatatacaaattcatccaaaaagtaagatcctagggtctagatttttgttttcattggcggtaaactacagttagcttgtacacatccagagggcaaaattactkttgaaatatttcagaattttgagaacagcttttggtttttgttttcttcatttttttttcttttgtgcttttaaagggttttgttctacttacagagtgttgtattgaagagagggtttgctgtagagacagaatagggagcatacctgttttcattttccctcactccagttcaggggctggcttcctgttcttttgagttcttacgcattcacctgccctggtactacagtgtgggcaagtggctgttgagagtgtttacaaatggaggagtcaagaccaaaaaagcactcagttacagtcctggtcattagacatgtatctttgaccttcagtgaacagaatgtgtatgcatgcgtgagtgtgtgtgtgtgtgtgtgtgtgtgtgtgtgtgtgttttcttaattgacctcacaatggataatttgacttccactgcagcttctgtggttccaagctcccataactttggcatctacttattgccgggtaactctgtg

SEQ ID NO: 462 - DNA, 1001 bp, Homo Sapiens
  allele 501: 10-268-381 : polymorphic base C or T
  misc_binding 481..500: 10-268-381.mis1, potential
  misc_binding 502..521: 10-268-381.mis2, potential complement
  primer_bind 121..138: upstream amplification primer
  primer_bind 521..540: downstream amplification primer, complement
  misc_binding 489..513: 10-268-381 potential probe
gggacatgcaagagcagaagcagggcttaactttccctgctgccatctgctgggctgggcttcccattgctctggattgactgcctgggagccagagtcggcttagactgtagtggtcatgccttacaactgctttcctctgtagaaaagccaaaaagaaaatatcttgattgaaatgtcttttcttctcagctgtgtccgtgtttttattaaaatatttttttttcaggttaaatgagggacatactgtgtacttggaacgccacatttgcggacgattgtttggtgaaaagttcagacattttaatgctctgggaggatggggagaactacagaattcggtaaaggagtcaaagttttaaaaaccttcatccaaagttgtataggtgttaaaaactgagtttttataaaagcgtctttactgtgtagcaaccaaaaagtcatttttacaagtgtggaaagtgaagtcaatgctggtataacactgtgttgatccacacygttcactgttctatgtaaggtagttttgatgacctggtctaaatagggagctgtgggacctcactgggtctttgctattaatatagctgtttactatgtttgcatcttatttggtatgtcatttttaagtgttgtctcctgaaagccaaatttgctgaccaggcattaaatcatttttctagtctttttataagaataaagcctgtattattgagcaagaaacaacagagaatattacttaagtaagcattctattaatagacttccagaagtttatgccaacatatcctagtgttccagtctccaagttttagattcccctaaagttacaccactgagtgaagtaatacctccttattagcttatttgcgtggtgatagcagtctttctatatgtttctccatgttatttcatgtcttgcaggtaaagacatttggggagacacatcctttcaccaaacttgtggttgatctgacagatatagaccctgatgtagctta

SEQ ID NO: 463 - DNA, 1001 bp, Homo Sapiens
  allele 501: 12-54-297 : polymorphic base C or T
  misc_binding 482..500: 12-54-297.mis1
  misc_binding 502..521: 12-54-297.mis2, potential complement
  primer_bind 210..228: upstream amplification primer
  primer_bind 647..667: downstream amplification primer, complement
  misc_binding 489..513: 12-54-297 potential probe
ataagagcataactactgatgactggaaggatttcctgtattcctattttaaagataaggttggatttaaaaaccttttctatttttcatgctcgatatatctctatttattgactgattaggttaacttgtattatctaatagtagtattggttcagaactttaggactcaacctctcattgcatattttttctattttaaatgtgatcttaaccacatgaactacctgtagaattttcctatttcagagaagtcatcaatagtatggtgatgaatataaattttagaagatagagttagatgaggtaatggatatattagcttgacttagtccacattgagtacatatatcaaaacatcgcattgtgtcacataagtatacacaattatgatctatcaatttaaaatattaatttttaaaaaagatttagaaattatcttgatatagcagattagacaaaattatatatctaaggacttacaagtttaaattttttttygacaggaaagggcattctattgtaaactgtgaattcttactattcataggttgatgttctcaatcaagttgattggaatgcctggctctactctcctggactgcctcccataaagcccaagtaagtacttgcctgctaatgctttccttctcattctcctaactcctagagagcctcaaaatatctgaaagaatagtatgccttcctgaaactgttactagtaaatgatgaaagcagagttcttaggtgttttggccttaaccctgaggccaaaagaataatttctgcagtttacaaatatggtttttcacttcaagtaattgagtgcctcctttctgcacaaggatggtgagggatttagacaataagctattgtatcttccttcaaacttctgcaataaaaatattttataagtattatgttaattacaacactgttataagttattatccccatttcccaaggaggtaagttaggtttagctaggtaaagtgtcttg

SEQ ID NO: 464 - DNA, 1001 bp, Homo Sapiens
  allele 501: 10-276-407 : polymorphic base C or T
  misc_binding 481..500: 10-276-407.mis1, potential
  misc_binding 502..521: 10-276-407.mis2, potential complement
  primer_bind 95..113: upstream amplification primer
  primer_bind 511..530: downstream amplification primer, complement
  misc_binding 489..513: 10-276-407 potential probe
ttcttattctctttctccttcctttttcctttcctctgaaccccttccctcctttctttcttctctccctccctttctcctcctctgtctccttctcgcctttctttcttttcaattttttcttttttggcagggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttcttatagtggcatattctttgtaaattttaacaaggtttaatcttttgatttacaaattaaaaaattttgaattagctttatattaattttctcycagtatgatcacaaaatatgtcaaggtagtattttacctgatatatgatttaaattcattaatttgaatctgctgcagattcaaaaattcaacatggttaggattttgctttgctttttaaataaccttaaacataagtccgggcgcagtggttcatgcctgtaatcccagcactttgggaggccaaggcgggtgaatcacctgaggtcaggagtttgagaccagcctggccaacatggtgaaaccccgtctctactaaaaatacaaaaattagctgggcgtggaggcacgactgtaattccagctactcaggaggctgagggaggataagcactttaatctgggaggcaggggttgtagtgagccgagatggcgccattgcactccagcctgggcaatggagactctgcctcgaaaaataaaaaattaaaaaaaaaccttaaacatgaatgcttagttgtatttgcacaccacctacctggtggacagcagatgaactc

SEQ ID NO: 465 - DNA, 1001 bp, Homo Sapiens
  allele 501: 12-44-50 : polymorphic base T or C
  misc_binding 502..521: 12-44-50.mis1, potential complement
  misc_binding 482..500: 12-44-50.mis2
  primer_bind 530..550: upstream amplification primer, complement
  primer_bind 147..166: downstream amplification primer
  misc_binding 489..513: 12-44-50 potential probe
agtggcaggatatgagggaactcaactctggagctttcttcttggataggaaaattctaatgtggaaaccagatttgcagtgattggaggtattgtcccttctcacaggtaaggacaagccttctaggtcagtggagactcagaactctttgaggggaaggagagggaggagaagcagtgctgaggcagtcacaaacagcaaaacacattcttgagtttccatgttatggacgcaagtggcacgtgaataggatctgccaatgagtggagagcaatttcaatgagcagtctattgtatatacagggctgtgctgaacagactagtagtgattccaacacctatttttactcctaccttggtctgccatactatatagccctaaaatcccagatagtagcactccaaccttaaacccacctgtactttatgggggagtctaaggcacctctgagaattccccagcgtgaactatcagccagaagttggtctgtggatggcaytgccatacccgactgacattatttaacagttggaaaaaatgctgctgtcaggaatctgattttatttcagaaaaatgaagcctcttttttggtaactttttgggaatttcttagaaaatggcacgtgttcattgataaggggcagtggagtgtagactgggtgactggcaaaatgaaaagactcagttgcctatgacttctcttcccctgggaaaccttgttaatgctttggtgcaccacctccttctggaacattttatattacttttccaatgtttccaaacattttccaatagctgtgaatggctaaacttggtcaaatgaatgtcctttaatttcatatttagataatttctaactatttttcctataataaacaatgaactgtaaaacaaaaacaaaaacaaaaaaaaacagctagttcctgatcacttcttcaagatatattgctaaaatttctacaagtggaagtactaggttgaattagagcacacagattt

SEQ ID NO: 466 - DNA, 1001 bp, Homo Sapiens
  allele 501: 12-44-67 : polymorphic base T or C
  misc_binding 481..500: 12-44-67.mis1, potential
  misc_binding 502..521: 12-44-67.mis2, potential complement
  primer_bind 547..567: upstream amplification primer, complement
  primer_bind 164..183: downstream amplification primer
  misc_binding 489..513: 12-44-67 potential probe
taatcaagaagccatgtagtggcaggatatgagggaactcaactctggagctttcttcttggataggaaaattctaatgtggaaaccagatttgcagtgattggaggtattgtcccttctcacaggtaaggacaagccttctaggtcagtggagactcagaactctttgaggggaaggagagggaggagaagcagtgctgaggcagtcacaaacagcaaaacacattcttgagtttccatgttatggacgcaagtggcacgtgaataggatctgccaatgagtggagagcaatttcaatgagcagtctattgtatatacagggctgtgctgaacagactagtagtgattccaacacctatttttactcctaccttggtctgccatactatatagccctaaaatcccagatagtagcactccaaccttaaacccacctgtactttatgggggagtctaaggcacctctgagaattccccagcgtgaactatcagccagaagytggtctgtggatggcactgccatacccgactgacattatttaacagttggaaaaaatgctgctgtcaggaatctgattttatttcagaaaaatgaagcctcttttttggtaactttttgggaatttcttagaaaatggcacgtgttcattgataaggggcagtggagtgtagactgggtgactggcaaaatgaaaagactcagttgcctatgacttctcttcccctgggaaaccttgttaatgctttggtgcaccacctccttctggaacattttatattacttttccaatgtttccaaacattttccaatagctgtgaatggctaaacttggtcaaatgaatgtcctttaatttcatatttagataatttctaactatttttcctataataaacaatgaactgtaaaacaaaaacaaaaacaaaaaaaaacagctagttcctgatcacttcttcaagatatattgctaaaatttctacaagtggaagtactaggttgaa

SEQ ID NO: 467 - DNA, 1001 bp, Homo Sapiens
  allele 501: 12-45-145 : polymorphic base A or G
  misc_binding 481..500: 12-45-145.mis1, potential
  misc_binding 502..521: 12-45-145.mis2, potential complement
  primer_bind 357..375: upstream amplification primer
  primer_bind 804..824: downstream amplification primer, complement
  misc_binding 489..513: 12-45-145 potential probe
gtcctgccggtggcccgagcccggtggcctcccggcgaccctcggcgcgaggcgacatggcaagcggccacagcctcctgctggagaacgcgcagcaagtggtgctggtgtgcgcccgcggcgagcgcttcctggcgcgggatgcgctgcgcagcctggcggtgctggaaggcgccagcctggtggtgggcaagtaagtggccgggcgcgcagggtggggaccgccacgggcggagctggccgctcttcctctcactgtgcactctggagggaaacaacgccgtgaaagcgtccctgcacagagatacacgggcaagccagcctttggggtacctgttgctaacacgctctgctgcttggggttgtcattccgtccaaagagctcagagaggaacaccccattggaacgcatcagggtcctgcctctgctggtaaaatatcactgtccaaccatcagaaggggttgaggtcctccccagtgcttcttaaagggaggccagragaccacctttgtcagggtggcctgtggttattttattcttacggcagatttctgattccacctgcgtcccccactccctatccctagaattttagaatcagcatcactggggctggagttctgagacctgaatttttcaaaagtacctttcacatcctcgtgatctcgtacactaaagctttagaaccacggagaacatttagacgataatggccctgagtgataataaatcaagatttgaccatcagaaaacaagatatttctcttactcatctgagcttcctgccagatatgaataaaagaacaaagtttgagggcgacctggggtagcaagggaagttggatgagaatttgaatccaaagcgtgccatgggaccacaattgcacacgatcaatgagtctcacaaactgaccacggcttatctgaggcagtttagggttgtgcaagagcccagcttttaagggactgtgggttggtttaattttatttatttattta

SEQ ID NO: 468 - DNA, 1001 bp, Homo Sapiens
  allele 501: 12-45-166 : polymorphic base A or G
  misc_binding 481..500: 12-45-166.mis1, potential
  misc_binding 502..521: 12-45-166.mis2, potential complement
  primer_bind 336..354: upstream amplification primer
  primer_bind 783..803: downstream amplification primer, complement
  misc_binding 489..513: 12-45-166 potential probe
cggtggcctcccggcgaccctcggcgcgaggcgacatggcaagcggccacagcctcctgctggagaacgcgcagcaagtggtgctggtgtgcgcccgcggcgagcgcttcctggcgcgggatgcgctgcgcagcctggcggtgctggaaggcgccagcctggtggtgggcaagtaagtggccgggcgcgcagggtggggaccgccacgggcggagctggccgctcttcctctcactgtgcactctggagggaaacaacgccgtgaaagcgtccctgcacagagatacacgggcaagccagcctttggggtacctgttgctaacacgctctgctgcttggggttgtcattccgtccaaagagctcagagaggaacaccccattggaacgcatcagggtcctgcctctgctggtaaaatatcactgtccaaccatcagaaggggttgaggtcctccccagtgcttcttaaagggaggccagaagaccacctttgtcagggtgrcctgtggttattttattcttacggcagatttctgattccacctgcgtcccccactccctatccctagaattttagaatcagcatcactggggctggagttctgagacctgaatttttcaaaagtacctttcacatcctcgtgatctcgtacactaaagctttagaaccacggagaacatttagacgataatggccctgagtgataataaatcaagatttgaccatcagaaaacaagatatttctcttactcatctgagcttcctgccagatatgaataaaagaacaaagtttgagggcgacctggggtagcaagggaagttggatgagaatttgaatccaaagcgtgccatgggaccacaattgcacacgatcaatgagtctcacaaactgaccacggcttatctgaggcagtttagggttgtgcaagagcccagcttttaagggactgtgggttggtttaattttatttatttatttatttatttatttatttatttat

SEQ ID NO: 469 - DNA, 1001 bp, Homo Sapiens
  allele 501: 12-45-305 : polymorphic base C or T
  misc_binding 481..500: 12-45-305.mis1, potential
  misc_binding 502..521: 12-45-305.mis2, potential complement
  primer_bind 198..216: upstream amplification primer
  primer_bind 645..665: downstream amplification primer, complement
  misc_binding 489..513: 12-45-305 potential probe
cggtgctggaaggcgccagcctggtggtgggcaagtaagtggccgggcgcgcagggtggggaccgccacgggcggagctggccgctcttcctctcactgtgcactctggagggaaacaacgccgtgaaagcgtccctgcacagagatacacgggcaagccagcctttggggtacctgttgctaacacgctctgctgcttggggttgtcattccgtccaaagagctcagagaggaacaccccattggaacgcatcagggtcctgcctctgctggtaaaatatcactgtccaaccatcagaaggggttgaggtcctccccagtgcttcttaaagggaggccagaagaccacctttgtcagggtggcctgtggttattttattcttacggcagatttctgattccacctgcgtcccccactccctatccctagaattttagaatcagcatcactggggctggagttctgagacctgaatttttcaaaagtacctttcacatccycgtgatctcgtacactaaagctttagaaccacggagaacatttagacgataatggccctgagtgataataaatcaagatttgaccatcagaaaacaagatatttctcttactcatctgagcttcctgccagatatgaataaaagaacaaagtttgagggcgacctggggtagcaagggaagttggatgagaatttgaatccaaagcgtgccatgggaccacaattgcacacgatcaatgagtctcacaaactgaccacggcttatctgaggcagtttagggttgtgcaagagcccagcttttaagggactgtgggttggtttaattttatttatttatttatttatttatttatttatttatttatttttgagacgcatgagccactgcgcccagcctattttttgtttttttgagacagggtctagctctgttgcccaggttggagtgcagtggcatgatcttggctccacctcccaggctcaactgcgatctccacct

SEQ ID NO: 470 - DNA, 1001 bp, Homo Sapiens
  allele 501: 12-46-92 : polymorphic base A or G
  misc_binding 481..500: 12-46-92.mis1, potential
  misc_binding 502..520: 12-46-92.mis2, complement
  primer_bind 410..429: upstream amplification primer
  primer_bind 792..811: downstream amplification primer, complement
  misc_binding 489..513: 12-46-92 potential probe
caagggatcgccaatggaaatctctcttcctatcgctttgagcaagtatgaatgttatgatctttctcttttacagctaaataatggggaaacatattcttaactaatttaaatattttttctttttaaattttagtttgtaaatatgtaatgattggtacactacttatcctgatcttctgttcagattaaagttgatacagcagttaaaattatatatacttaagatactaaaaatgttgtttgtatataatacaacaaggactttgggaactgttagtttctaaacgattcatccttttactaatatctagagtgatggtgggggcatgccatcataagaaggcatttcaagataacctgggcagctttacaagttgcaccctccttgcccttgccccagaggccagctgcatttattaatgggacaatgataatgccaaagatagaactgttacagtgcagcaatcttgggataagtgctttaaatgcattcttgtrtctaatccttacagtaaccctgctggtataatctacacttaaagatgaggaaagggaaccttagagaaataacttattcaagaaagtggcaaccagaattgtcacactgggagtatatgccacctcttgaggggaaagagggtgaaaactattggcctagaacaagggtgatctaccccagttgttcagaggccagtgttttcatgccttctctttccctttaagagaagggaaacacttaagtctagcttgtgaggtagatggtattcaccccattctacaaggaaactgtggcatagggaggtcaaataatttccccaagtttacagtaccagtaagtgatagagtcaggattcgaacaccagcagggctgctggtctctaaacctctgctgtttccttattatcagtgcttctcaaactctctggggtaaaggaccaatttctatcctcttcaatctgtcatagactgatacttttgtacaatgcaataaaaatgaa

SEQ ID NO: 471 - DNA, 1001 bp, Homo Sapiens
  allele 501: 12-47-132 : polymorphic base C or T
  misc_binding 482..500: 12-47-132.mis1
  misc_binding 502..521: 12-47-132.mis2, potential complement
  primer_bind 370..388: upstream amplification primer
  primer_bind 756..776: downstream amplification primer, complement
  misc_binding 489..513: 12-47-132 potential probe
  misc_feature 647: n=a, g, c or t
tttttttaatgagacttttaaaacatattcaaagtggagagaagagtaccatgaactctcacaccccaccttgattcaacagcacattcaatttatgaagtacactatgaactctagtgagtgcagacaggtcacagtgggagaggatgaagttgtggaattcacggtggacctggaagcaatttctcatcttctagtccagtatccccaccccgcaattcatatggaattggaaaccacgagatgtaaagcatcttgatgaaatgcatacaattatttaatagaactggggctcaagatgaggatcagctcttctttctgacttccttccctacccacatgacccaaacttggccaacaaacctttgttagaggatgtgaatgggggacatggcagattttgctagtgcagatgaatgggcagcttcccgggtaggtgtgcaggtctggtaattattcaggtaaatgtctcaattctccccttctcagcattaaagatayagtcaaggggttagaaaacaggttaaaatggcaactaaataccaaagcaacttcattctaccaatagacagagaacaaaccatctgttagttgggtggtgatgggtgtcaactttgggaaatccacattccttaagcatgaagtcnagactttcataagctaccctcttggaatttcttgtttcagtgctggccatcgagctccttgcagcctgccagggcatagagtttctacgtcccctgaaaacaaccactccgctggagaaaggtctatgacctggtgcgctctgttgtaaggtaagatcaaacaggtctctgaaaattacatcagttcagcactgtgaaccctggcagggtttcatgtttggctgatgggcggatgtgctctccctgtaggccctggataaaagatcgcttcatggccccggacatcgaggcagcccacaggctgctcctggagcagaaggcaagctggctccttggcttgtttcttaattttta

SEQ ID NO: 472 - DNA, 1001 bp, Homo Sapiens
  allele 501: 12-47-61 : polymorphic base C or T
  misc_binding 481..500: 12-47-61.mis1, potential
  misc_binding 502..521: 12-47-61.mis2, potential complement
  primer_bind 441..459: upstream amplification primer
  primer_bind 827..847: downstream amplification primer, complement
  misc_binding 489..513: 12-47-61 potential probe
  misc_feature 718: n=a, g, c or t
gctgtgttgccttggctggtctcaaactcttggcctcaagcgatcctcccacctcacccccaaagtggttttttttttaatgagacttttaaaacatattcaaagtggagagaagagtaccatgaactctcacaccccaccttgattcaacagcacattcaatttatgaagtacactatgaactctagtgagtgcagacaggtcacagtgggagaggatgaagttgtggaattcacggtggacctggaagcaatttctcatcttctagtccagtatccccaccccgcaattcatatggaattggaaaccacgagatgtaaagcatcttgatgaaatgcatacaattatttaatagaactggggctcaagatgaggatcagctcttctttctgacttccttccctacccacatgacccaaacttggccaacaaacctttgttagaggatgtgaatgggggacatggcagattttgctagtgcagatgaatgggcagcttccygggtaggtgtgcaggtctggtaattattcaggtaaatgtctcaattctccccttctcagcattaaagatatagtcaaggggttagaaaacaggttaaaatggcaactaaataccaaagcaacttcattctaccaatagacagagaacaaaccatctgttagttgggtggtgatgggtgtcaactttgggaaatccacattccttaagcatgaagtcnagactttcataagctaccctcttggaatttcttgtttcagtgctggccatcgagctccttgcagcctgccagggcatagagtttctacgtcccctgaaaacaaccactccgctggagaaaggtctatgacctggtgcgctctgttgtaaggtaagatcaaacaggtctctgaaaattacatcagttcagcactgtgaaccctggcagggtttcatgtttggctgatgggcggatgtgctctccctgtaggccctggataaaagatcgcttcatggccccggac

SEQ ID NO: 473 - DNA, 1001 bp, Homo Sapiens
  allele 501: 12-48-100 : polymorphic base A or G
  misc_binding 481..500: 12-48-100.mis1, potential
  misc_binding 502..521: 12-48-100.mis2, potential complement
  primer_bind 403..421: upstream amplification primer
  primer_bind 904..921: downstream amplification primer, complement
  misc_binding 489..513: 12-48-100 potential probe
  misc_feature 319: n=a, g, c or t
ctcctgcacagacggagaatgttagagatttatttcttaggtttgactttgttaaaacaacctctcttaaagcagtgtcagtcattaactctttgcataagagcattctctttgttctttcccattcaagggtcaatttctaatcctgccggtcctttccaccaccagattcactgcacactgggtagattatctaactgggccagataaaagctgttagtgatgaagaattgtcttaatcaggatactaaattctatttcaagacttaatttcttattccaccctaagtttatcctccccaaatctcccacaatcatntatttcttttcctatcataacatcttctctttccatccagtttcttctgctcttccactcttacattttgttaggttaccccaaccacttctgtcccagttcggaatccttatcctaattgcttttcacaacacattccagctctcaggtttatagccctcaatctccatgttggaaatacraatttgttgtaagtgaccaagacctaaattaatagtggctgaaacaagatggaagtatatttctctcctatgtgaaaatccagacatacgaatgcagggctagttgattgcaatactccatggggtccttaggagccaggcccctgctgccttgctctcccatgcatggcccactttcttacactcactccatgacccaagatggccaccccatctctagttgtggtgtctgcattccagccagtaagaataggaagagaagacaatcttaccggctagaccttagtctcatagccacacctggctagtgggaggtggggaaatgtagtctgtattttgggtcatcatgtgtccagctaaaatttagggctctactagtgtaaaaaagggaacattgatcttggggaacaaatggcaattgtctgctacatatatttgacgtttaaagtttttttaattgtaaattttcatgggtacatatatatggggtacatgagtta

SEQ ID NO: 474 - DNA, 1001 bp, Homo Sapiens
  allele 501: 12-48-323 : polymorphic base A or G
  misc_binding 481..500: 12-48-323.mis1, potential
  misc_binding 502..521: 12-48-323.mis2, potential complement
  primer_bind 180..198: upstream amplification primer
  primer_bind 681..698: downstream amplification primer, complement
  misc_binding 489..513: 12-48-323 potential probe
  misc_feature 96: n=a, g, c or t
tgaagaattgtcttaatcaggatactaaattctatttcaagacttaatttcttattccaccctaagtttatcctccccaaatctcccacaatcatntatttcttttcctatcataacatcttctctttccatccagtttcttctgctcttccactcttacattttgttaggttaccccaaccacttctgtcccagttcggaatccttatcctaattgcttttcacaacacattccagctctcaggtttatagccctcaatctccatgttggaaatacgaatttgttgtaagtgaccaagacctaaattaatagtggctgaaacaagatggaagtatatttctctcctatgtgaaaatccagacatacgaatgcagggctagttgattgcaatactccatggggtccttaggagccaggcccctgctgccttgctctcccatgcatggcccactttcttacactcactccatgacccaagatggccaccccatctctagttrtggtgtctgcattccagccagtaagaataggaagagaagacaatcttaccggctagaccttagtctcatagccacacctggctagtgggaggtggggaaatgtagtctgtattttgggtcatcatgtgtccagctaaaatttagggctctactagtgtaaaaaagggaacattgatcttggggaacaaatggcaattgtctgctacatatatttgacgtttaaagtttttttaattgtaaattttcatgggtacatatatatggggtacatgagttattttaaacagtcgtacaatgtgtaataattatatcagggtaaatggggtttccatcatctcaagcattcatcatttcctggtgttacaaacattccaatcgtactccctcagttattctaaaatgtgcaacatattattgctgattgtagtcaccctgttgtgatatcaaatactgggtcttattcactgtatctaaccatatttttctagccattaacaatc

SEQ ID NO: 475 - DNA, 1001 bp, Homo Sapiens
  allele 501: 12-48-369 : polymorphic base C or T
  misc_binding 481..500: 12-48-369.mis1, potential
  misc_binding 502..521: 12-48-369.mis2, potential complement
  primer_bind 134..152: upstream amplification primer
  primer_bind 635..652: downstream amplification primer, complement
  misc_binding 489..513: 12-48-369 potential probe
  misc_feature 50: n=a, g, c or t
atttcttattccaccctaagtttatcctccccaaatctcccacaatcatntatttcttttcctatcataacatcttctctttccatccagtttcttctgctcttccactcttacattttgttaggttaccccaaccacttctgtcccagttcggaatccttatcctaattgcttttcacaacacattccagctctcaggtttatagccctcaatctccatgttggaaatacgaatttgttgtaagtgaccaagacctaaattaatagtggctgaaacaagatggaagtatatttctctcctatgtgaaaatccagacatacgaatgcagggctagttgattgcaatactccatggggtccttaggagccaggcccctgctgccttgctctcccatgcatggcccactttcttacactcactccatgacccaagatggccaccccatctctagttgtggtgtctgcattccagccagtaagaataggaagagaagacaatcytaccggctagaccttagtctcatagccacacctggctagtgggaggtggggaaatgtagtctgtattttgggtcatcatgtgtccagctaaaatttagggctctactagtgtaaaaaagggaacattgatcttggggaacaaatggcaattgtctgctacatatatttgacgtttaaagtttttttaattgtaaattttcatgggtacatatatatggggtacatgagttattttaaacagtcgtacaatgtgtaataattatatcagggtaaatggggtttccatcatctcaagcattcatcatttcctggtgttacaaacattccaatcgtactccctcagttattctaaaatgtgcaacatattattgctgattgtagtcaccctgttgtgatatcaaatactgggtcttattcactgtatctaaccatatttttctagccattaacaatccccatttttctcctctccccttctattcttcccagcctctggtaac

SEQ ID NO: 476 - DNA, 1001 bp, Homo Sapiens
  allele 501: 12-48-37 : polymorphic base C or T
  misc_binding 481..500: 12-48-37.mis1, potential
  misc_binding 502..521: 12-48-37.mis2, potential complement
  primer_bind 466..484: upstream amplification primer
  primer_bind 967..984: downstream amplification primer, complement
  misc_binding 489..513: 12-48-37 potential probe
  misc_feature 382: n=a, g, c or t
gaaaggtagataagcatgggattagtggggtcaggaagaggacccagtgccctcaaaattcacctcctgcacagacggagaatgttagagatttatttcttaggtttgactttgttaaaacaacctctcttaaagcagtgtcagtcattaactctttgcataagagcattctctttgttctttcccattcaagggtcaatttctaatcctgccggtcctttccaccaccagattcactgcacactgggtagattatctaactgggccagataaaagctgttagtgatgaagaattgtcttaatcaggatactaaattctatttcaagacttaatttcttattccaccctaagtttatcctccccaaatctcccacaatcatntatttcttttcctatcataacatcttctctttccatccagtttcttctgctcttccactcttacattttgttaggttaccccaaccacttctgtcccagttcggaatccttatcctaaytgcttttcacaacacattccagctctcaggtttatagccctcaatctccatgttggaaatacgaatttgttgtaagtgaccaagacctaaattaatagtggctgaaacaagatggaagtatatttctctcctatgtgaaaatccagacatacgaatgcagggctagttgattgcaatactccatggggtccttaggagccaggcccctgctgccttgctctcccatgcatggcccactttcttacactcactccatgacccaagatggccaccccatctctagttgtggtgtctgcattccagccagtaagaataggaagagaagacaatcttaccggctagaccttagtctcatagccacacctggctagtgggaggtggggaaatgtagtctgtattttgggtcatcatgtgtccagctaaaatttagggctctactagtgtaaaaaagggaacattgatcttggggaacaaatggcaattgtctgctacatatattt

SEQ ID NO: 477 - DNA, 1001 bp, Homo Sapiens
  allele 501: 12-49-131 : polymorphic base T or C
  misc_binding 502..521: 12-49-131.mis1, potential complement
  misc_binding 482..500: 12-49-131.mis2
  primer_bind 613..630: upstream amplification primer, complement
  primer_bind 180..200: downstream amplification primer
  misc_binding 489..513: 12-49-131 potential probe
aagaattacctcagagtaataatattcagcaaatttaaacttgccacctacttaaaatggattcatgaggacatattggccaccatctgctgttgaacgctgacaccagattactgagtaaagaatttgaaaattttctcaaaattgattgttccagacattttggtagttgctcatcagcagagtttcccattcaacagattcttctatggaacacaaatttgcagtgcccattgaagaaacagaagttgctttcaaacagatgtgttggtctctgtttttagtttcaggctataaaccttttgagggcaggtactaaccaccaggttagtacagttatggtgctttagaatctaatctcaagagaaaacatcatttcaaggttcatgttttttcagcctccaaattgggtgtacatgatccacctttaaggctttttgttttttgcttttgtgcccctttatatctcttgcaggaagacttgtctctttccctccaccycacatttgtacacagactgccacctccacgttaaaaaagaaggcaggaaggggttgtacttgaagtgaccagcaaacgttatcttcaagccttaacctcttttgaaagatggtctttgccaataggggagagacaatttctggaggaaacttccatggtgaatacccagccaaagtaagctttttagaactgctcttgacccagaaggcacatttcaatataggctgactaaatggagaccctctttcaggccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttggtaaggacactgcccctttcccagaacacacgcccgtccatctaagggtctttccatttcacctagaagtatcaaatgtggtct

SEQ ID NO: 478 - DNA, 1001 bp, Homo Sapiens
  allele 501: 12-49-53 : polymorphic base G or A
  misc_binding 481..500: 12-49-53.mis1, potential
  misc_binding 502..521: 12-49-53.mis2, potential complement
  primer_bind 535..552: upstream amplification primer, complement
  primer_bind 102..122: downstream amplification primer
  misc_binding 489..513: 12-49-53 potential probe
gccaccatctgctgttgaacgctgacaccagattactgagtaaagaatttgaaaattttctcaaaattgattgttccagacattttggtagttgctcatcagcagagtttcccattcaacagattcttctatggaacacaaatttgcagtgcccattgaagaaacagaagttgctttcaaacagatgtgttggtctctgtttttagtttcaggctataaaccttttgagggcaggtactaaccaccaggttagtacagttatggtgctttagaatctaatctcaagagaaaacatcatttcaaggttcatgttttttcagcctccaaattgggtgtacatgatccacctttaaggctttttgttttttgcttttgtgcccctttatatctcttgcaggaagacttgtctctttccctccaccccacatttgtacacagactgccacctccacgttaaaaaagaaggcaggaaggggttgtacttgaagtgaccagcaaacrttatcttcaagccttaacctcttttgaaagatggtctttgccaataggggagagacaatttctggaggaaacttccatggtgaatacccagccaaagtaagctttttagaactgctcttgacccagaaggcacatttcaatataggctgactaaatggagaccctctttcaggccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttggtaaggacactgcccctttcccagaacacacgcccgtccatctaagggtctttccatttcacctagaagtatcaaatgtggtctgtgagtgagatctaacttttcaccacttttatctgcatcctagttctctcagtgcaaaggtaacaggttaactctaat

SEQ ID NO: 479 - DNA, 1001 bp, Homo Sapiens
  allele 501: 12-49-64 : polymorphic base G or A
  misc_binding 481..500: 12-49-64.mis1, potential
  misc_binding 502..521: 12-49-64.mis2, potential complement
  primer_bind 546..563: upstream amplification primer, complement
  primer_bind 113..133: downstream amplification primer
  misc_binding 489..513: 12-49-64 potential probe
aggacatattggccaccatctgctgttgaacgctgacaccagattactgagtaaagaatttgaaaattttctcaaaattgattgttccagacattttggtagttgctcatcagcagagtttcccattcaacagattcttctatggaacacaaatttgcagtgcccattgaagaaacagaagttgctttcaaacagatgtgttggtctctgtttttagtttcaggctataaaccttttgagggcaggtactaaccaccaggttagtacagttatggtgctttagaatctaatctcaagagaaaacatcatttcaaggttcatgttttttcagcctccaaattgggtgtacatgatccacctttaaggctttttgttttttgcttttgtgcccctttatatctcttgcaggaagacttgtctctttccctccaccccacatttgtacacagactgccacctccacgttaaaaaagaaggcaggaaggggttgtacttgaagtraccagcaaacgttatcttcaagccttaacctcttttgaaagatggtctttgccaataggggagagacaatttctggaggaaacttccatggtgaatacccagccaaagtaagctttttagaactgctcttgacccagaaggcacatttcaatataggctgactaaatggagaccctctttcaggccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttggtaaggacactgcccctttcccagaacacacgcccgtccatctaagggtctttccatttcacctagaagtatcaaatgtggtctgtgagtgagatctaacttttcaccacttttatctgcatcctagttctctcagtgcaaaggtaacagg

SEQ ID NO: 480 - DNA, 1001 bp, Homo Sapiens
  allele 501: 12-51-234 : polymorphic base T or C
  misc_binding 502..521: 12-51-234.mis1, potential complement
  misc_binding 483..500: 12-51-234.mis2
  primer_bind 717..734: upstream amplification primer, complement
  primer_bind 329..347: downstream amplification primer
  misc_binding 489..513: 12-51-234 potential probe
aggagacaaaaaggagtttgcttttcttggagaaaacatcaattctgttttgcaggtgttgggaaaccactaagtcctgagaggtgtcggatgctcttggctttaaggatcaatgtcttagccaaaggatacagtggcatttccctggagaccctcaaacaagtcatagaaatgtttaatggtaatgcaatggctccctagacggaacctctgtggaggctggacatgtaccacagggtagaattgattggccagatgctgaggaatcacctgagaagacatgaaataattgaaatgagtgggaaatgccgttggcaaaaagtaggatagttagatgggggaagaggagaaagtcgatcagagatgcttactcctatgaactttaacttattctgcaagaccctttccctagcatttgtcatcttcaagactagaacaggactcttaagtctgcccttacattcaagcctgcctagaagaaacttggattaagtggtacaygaatatggttagaaaaattgcatgatatcaatgtccatcccaaaggccaattcagtagttctggttggtgcctgggaatctgaaatcgtaatgtcccccaggtgatggccagacttgcacactaaaatccaacttcttgcaagggtagaacagaaatgcaaagaggttaatgactcccttgtaatcaagaagccatgtagtggcaggatatgagggaactcaactctggagctttcttcttggataggaaaattctaatgtggaaaccagatttgcagtgattggaggtattgtcccttctcacaggtaaggacaagccttctaggtcagtggagactcagaactctttgaggggaaggagagggaggagaagcagtgctgaggcagtcacaaacagcaaaacacattcttgagtttccatgttatggacgcaagtggcacgtgaataggatctgccaatgagtggagagcaatttcaatgagcagtctattgtatatac

SEQ ID NO: 481 - DNA, 1001 bp, Homo Sapiens
  allele 501: 12-51-253 : polymorphic base C or A
  misc_binding 481..500: 12-51-253.mis1, potential
  misc_binding 502..521: 12-51-253.mis2, potential complement
  primer_bind 736..753: upstream amplification primer, complement
  primer_bind 348..366: downstream amplification primer
  misc_binding 489..513: 12-51-253 potential probe
gggagggagggcaattgtcaggagacaaaaaggagtttgcttttcttggagaaaacatcaattctgttttgcaggtgttgggaaaccactaagtcctgagaggtgtcggatgctcttggctttaaggatcaatgtcttagccaaaggatacagtggcatttccctggagaccctcaaacaagtcatagaaatgtttaatggtaatgcaatggctccctagacggaacctctgtggaggctggacatgtaccacagggtagaattgattggccagatgctgaggaatcacctgagaagacatgaaataattgaaatgagtgggaaatgccgttggcaaaaagtaggatagttagatgggggaagaggagaaagtcgatcagagatgcttactcctatgaactttaacttattctgcaagaccctttccctagcatttgtcatcttcaagactagaacaggactcttaagtctgcccttacattcaagcctgcctagaagaamcttggattaagtggtacatgaatatggttagaaaaattgcatgatatcaatgtccatcccaaaggccaattcagtagttctggttggtgcctgggaatctgaaatcgtaatgtcccccaggtgatggccagacttgcacactaaaatccaacttcttgcaagggtagaacagaaatgcaaagaggttaatgactcccttgtaatcaagaagccatgtagtggcaggatatgagggaactcaactctggagctttcttcttggataggaaaattctaatgtggaaaccagatttgcagtgattggaggtattgtcccttctcacaggtaaggacaagccttctaggtcagtggagactcagaactctttgaggggaaggagagggaggagaagcagtgctgaggcagtcacaaacagcaaaacacattcttgagtttccatgttatggacgcaagtggcacgtgaataggatctgccaatgagtggagagcaatttcaatg

SEQ ID NO: 482 - DNA, 1001 bp, Homo Sapiens
  allele 501: 12-51-370 : polymorphic base G or A
  misc_binding 481..500: 12-51-370.mis1, potential
  misc_binding 502..521: 12-51-370.mis2, potential complement
  primer_bind 852..869: upstream amplification primer, complement
  primer_bind 464..482: downstream amplification primer
  misc_binding 489..513: 12-51-370 potential probe
tttgtcaggaagatggggctcagacaagtcagacaggcaggagggagagtagtccaactacctgagccgagaggagaaggtaatagcaggctgggctacatatgggaaagattggagggagggagggcaattgtcaggagacaaaaaggagtttgcttttcttggagaaaacatcaattctgttttgcaggtgttgggaaaccactaagtcctgagaggtgtcggatgctcttggctttaaggatcaatgtcttagccaaaggatacagtggcatttccctggagaccctcaaacaagtcatagaaatgtttaatggtaatgcaatggctccctagacggaacctctgtggaggctggacatgtaccacagggtagaattgattggccagatgctgaggaatcacctgagaagacatgaaataattgaaatgagtgggaaatgccgttggcaaaaagtaggatagttagatgggggaagaggagaaagtcgatcagagatrcttactcctatgaactttaacttattctgcaagaccctttccctagcatttgtcatcttcaagactagaacaggactcttaagtctgcccttacattcaagcctgcctagaagaaacttggattaagtggtacatgaatatggttagaaaaattgcatgatatcaatgtccatcccaaaggccaattcagtagttctggttggtgcctgggaatctgaaatcgtaatgtcccccaggtgatggccagacttgcacactaaaatccaacttcttgcaagggtagaacagaaatgcaaagaggttaatgactcccttgtaatcaagaagccatgtagtggcaggatatgagggaactcaactctggagctttcttcttggataggaaaattctaatgtggaaaccagatttgcagtgattggaggtattgtcccttctcacaggtaaggacaagccttctaggtcagtggagactcagaactctttgaggggaaggagaggg

SEQ ID NO: 483 - DNA, 1001 bp, Homo Sapiens
  allele 501: 12-52-400 : polymorphic base G or A
  misc_binding 481..500: 12-52-400.mis1, potential
  misc_binding 502..521: 12-52-400.mis2, potential complement
  primer_bind 881..900: upstream amplification primer, complement
  primer_bind 451..471: downstream amplification primer
  misc_binding 489..513: 12-52-400 potential probe
ttcatgctcctccaaaatggatggccaccatcacactttccccagagcagcagggtatagtgctgctgtttgcctgctgtctaagtgctctctatttcttaattgtaagataacttgatttattgattataggtttggtggatgcacacacacatccagtatgggctggtgaaagagttcacgaatttgcaatgaaggtaactgcaacaaatcatggcaaatcaaaataaagcacaaatatgaagtcttttgctgaagagttagtaggctatcaagctttgcaacatatgtcaacatattttttaatggatatttttacttgcttgggtatgggaaacaaatgacaacaaaacttatttataactgccccaaatcattgtattatacacagggctattcctgcccactaatgtctccctctctttccttccccacattcccattccaaatcgctatctctagtagcttttgaaagggctccaaggaatagtttgaaaattrccattcattggagtaaagcttggaaaaatatgttactaatcacaaaaataaaataccttaatttttctgttataaactgagacttattaagaatcacaaaatgtaagctgtgttagtcctatattagctgtaaccaactcctaaatccctggttggagagattttcacatgtgttttttaaaaaagaaaaaaaaagatgtgcctcctagcagctaaactggcttatttcaggaaaagaaaaaaaaaattcttttcttcagctatcatgtacctgcttcaacaaactagagctgtttttaagattgttttattaaatcacagaatttcagagccaaaagcagtccaatcctctcattgtatagacggagaaagagatttacagtccaatcctctcattatgtagatggagaaagctgggtctagagaagggaagagtgttgactagcgtcaccagctggaggatggcagaacccagatgaaaactccggccaggagacccc

SEQ ID NO: 484 - DNA, 1001 bp, Homo Sapiens
  allele 501: 12-57-192 : polymorphic base G or A
  misc_binding 502..520: 12-57-192.mis1, complement
  misc_binding 481..500: 12-57-192.mis2, potential
  primer_bind 672..692: upstream amplification primer, complement
  primer_bind 151..168: downstream amplification primer
  misc_binding 489..513: 12-57-192 potential probe
taggaagtaaggtctccttctgagaattagaggtggatgtcgagaaggtcctggcagaggggtcaaagttttggaaagtcactgtgggctggatggaataaaagggcaataccatcaaactatgtgatcacaggactttctctatcagtgtcttctgcctgggtgaacagatatgacagtttcttttaattttaaacagggtcttgctctcacccaggctggagtacagtggtataatcataactcattgcagcattgactgcctaggcttaagcaatccttccaagagatggctgttttttgtgatgactaaggggatgggtgttattccaagtgtagacataagtttagggatgcaaaggaatctcagagtgcttaagaaagagtggtccagtgagcgactagggaccagcttcctaggatagtaagtgaggatgctggtgggaagtggagggatgaagagactgactggaggtcaggtccaaggctggcagtgactaragtaaaagggcagctggaaggttgtggtcagaaggtggaatattggaatttcagatttcttaagtgtgtcaaattcaggtcgtgacagattccagggtgatttcttaagtgtgtcaaattcaggtcatgacaaattccagggtgcagtcatggtgtgggtatctgaagagcaagtttcaataaggctcaaggaagggtagctatttgtacgcttcctgggaagctgtcagcagatgagagggactctgggtatgagtataggtgtttttcttgagcaaccatgtctctcttcccaacagaagtctgatttagtggaaacagacttttcaggatttttctagtgcaataatcaaatctctaaaaattggcttacgatgaaagtgctgcttagtcaaaatagcatctgcatatctttgatgccgtaatcatgctatccagagttccttaataccaatggtaataaggcgggtgcagggagcagttatctgtggtgaagaagc

SEQ ID NO: 485 - DNA, 1001 bp, Homo Sapiens
  allele 501: 12-57-221 : polymorphic base G or A
  misc_binding 502..520: 12-57-221.mis1, complement
  misc_binding 482..500: 12-57-221.mis2
  primer_bind 701..721: upstream amplification primer, complement
  primer_bind 180..197: downstream amplification primer
  misc_binding 489..513: 12-57-221 potential probe
atgtgcagtcctcagttttctcacagatgtaggaagtaaggtctccttctgagaattagaggtggatgtcgagaaggtcctggcagaggggtcaaagttttggaaagtcactgtgggctggatggaataaaagggcaataccatcaaactatgtgatcacaggactttctctatcagtgtcttctgcctgggtgaacagatatgacagtttcttttaattttaaacagggtcttgctctcacccaggctggagtacagtggtataatcataactcattgcagcattgactgcctaggcttaagcaatccttccaagagatggctgttttttgtgatgactaaggggatgggtgttattccaagtgtagacataagtttagggatgcaaaggaatctcagagtgcttaagaaagagtggtccagtgagcgactagggaccagcttcctaggatagtaagtgaggatgctggtgggaagtggagggatgaagagactgactgraggtcaggtccaaggctggcagtgactagagtaaaagggcagctggaaggttgtggtcagaaggtggaatattggaatttcagatttcttaagtgtgtcaaattcaggtcgtgacagattccagggtgatttcttaagtgtgtcaaattcaggtcatgacaaattccagggtgcagtcatggtgtgggtatctgaagagcaagtttcaataaggctcaaggaagggtagctatttgtacgcttcctgggaagctgtcagcagatgagagggactctgggtatgagtataggtgtttttcttgagcaaccatgtctctcttcccaacagaagtctgatttagtggaaacagacttttcaggatttttctagtgcaataatcaaatctctaaaaattggcttacgatgaaagtgctgcttagtcaaaatagcatctgcatatctttgatgccgtaatcatgctatccagagttccttaataccaatggtaataaggcgggtg

SEQ ID NO: 486 - DNA, 1010 bp, Homo Sapiens
  allele 501: 12-57-510 : polymorphic base C or A
  misc_binding 481..500: 12-57-510.mis1, potential
  misc_binding 502..521: 12-57-510.mis2, potential complement
  primer_bind 990..1010: upstream amplification primer, complement
  primer_bind 469..486: downstream amplification primer
  misc_binding 489..513: 12-57-510 potential probe
tgggctgaaattactcagaagctggtctcggcagtgacagtcaactggagcatgcagtagtttgggttgttttgcagcatgaagatagttagacctcttattagtcatctttatacagctttatccatcaccagacagtaagcctcatgaatgtagagcgtgtttgttatttatttcatccccagcacctcgcatagagcttgttacataacaggtgttgaaaaaatatttgttaaatgagtcaaggaatgaatgggggggggtggggcagaaggttaaggtggttcacatgtgcagtcctcagttttctcacagatgtaggaagtaaggtctccttctgagaattagaggtggatgtcgagaaggtcctggcagaggggtcaaagttttggaaagtcactgtgggctggatggaataaaagggcaataccatcaaactatgtgatcacaggactttctctatcagtgtcttctgcctgggtgaacagatatgacagtttmttttaattttaaacagggtcttgctctcacccaggctggagtacagtggtataatcataactcattgcagcattgactgcctaggcttaagcaatccttccaagagatggctgttttttgtgatgactaaggggatgggtgttattccaagtgtagacataagtttagggatgcaaaggaatctcagagtgcttaagaaagagtggtccagtgagcgactagggaccagcttcctaggatagtaagtgaggatgctggtgggaagtggagggatgaagagactgactggaggtcaggtccaaggctggcagtgactagagtaaaagggcagctggaaggttgtggtcagaaggtggaatattggaatttcagatttcttaagtgtgtcaaattcaggtcgtgacagattccagggtgatttcttaagtgtgtcaaattcaggtcatgacaaattccagggtgcagtcatggtgtgggtatctgaagagcaagtttcaataaggctcaag

SEQ ID NO: 487 - DNA, 448 bp, Homo Sapiens
  allele 139: 10-1-139 : polymorphic base G or T
  misc_binding 119..138: 10-1-139.mis1, potential
  misc_binding 140..158: 10-1-139.mis2, complement
  primer_bind 1..20: upstream amplification primer
  primer_bind 429..448: downstream amplification primer, complement
  misc_binding 127..151: 10-1-139 potential probe
acccatcattggtcctggagctccccagcccctttcctaggcctcaggacctcaccctccatcccgtctgccctgcaggatgtcgctgctgagcctgtcttggctgggcctcaggccggtggcagcatccccgtggctkctcctgctggtggtcggggcctcctggctcctggcccgcatcctggcctggacctatgccttctatcacaacggccgccgcctccggtgtttcccgcagccccggaaacagaactggttcttgggtcacctgggcctggtgagtggcaggaggatggatctagtgtctcagggtggaagggtggaaatggggctcaggctgagggggtgggctcgggtctgggacggcagagaaactcactcattcctctgatcactcactcattcctcttcccactcattcctctcctcactcactcattcctctcct

SEQ ID NO: 488 - DNA, 448 bp, Homo Sapiens
  allele 212: 10-1-212 : polymorphic base G or T
  misc_binding 192..211: 10-1-212.mis1, potential
  misc_binding 213..231: 10-1-212.mis2, complement
  primer_bind 1..20: upstream amplification primer
  primer_bind 429..448: downstream amplification primer, complement
  misc_binding 200..224: 10-1-212 potential probe
acccatcattggtcctggagctccccagcccctttcctaggcctcaggacctcaccctccatcccgtctgccctgcaggatgtcgctgctgagcctgtcttggctgggcctcaggccggtggcagcatccccgtggctkctcctgctggtggtcggggcctcctggctcctggcccgcatcctggcctggacctatgccttctatcacaackgccgccgcctccggtgtttcccgcagccccggaaacagaactggttcttgggtcacctgggcctggtgagtggcaggaggatggatctagtgtctcagggtggaagggtggaaatggggctcaggctgagggggtgggctcgggtctgggacggcagagaaactcactcattcctctgatcactcactcattcctcttcccactcattcctctcctcactcactcattcctctcct

SEQ ID NO: 489 - DNA, 448 bp, Homo Sapiens
  allele 241: 10-1-241 : polymorphic base A or C
  misc_binding 222..240: 10-1-241.mis1
  misc_binding 242..261: 10-1-241.mis2, potential complement
  primer_bind 1..20: upstream amplification primer
  primer_bind 429..448: downstream amplification primer, complement
  misc_binding 229..253: 10-1-241 potential probe
acccatcattggtcctggagctccccagcccctttcctaggcctcaggacctcaccctccatcccgtctgccctgcaggatgtcgctgctgagcctgtcttggctgggcctcaggccggtggcagcatccccgtggctkctcctgctggtggtcggggcctcctggctcctggcccgcatcctggcctggacctatgccttctatcacaacggccgccgcctccggtgtttcccgcagccmcggaaacagaactggttcttgggtcacctgggcctggtgagtggcaggaggatggatctagtgtctcagggtggaagggtggaaatggggctcaggctgagggggtgggctcgggtctgggacggcagagaaactcactcattcctctgatcactcactcattcctcttcccactcattcctctcctcactcactcattcctctcct

SEQ ID NO: 490 - DNA, 351 bp, Homo Sapiens
  allele 143: 10-9-143 : polymorphic base A or G
  misc_binding 123..142: 10-9-143.mis1, potential
  misc_binding 144..162: 10-9-143.mis2, complement
  primer_bind 1..18: upstream amplification primer
  primer_bind 332..351: downstream amplification primer, complement
  misc_binding 131..155: 10-9-143 potential probe
cccttkccttgcttgcaggtcactcccacagaggagggcttgagggtcctgacccagctggtggccacctacccccagggctttgtgaggtggttgggccccatcactcccatcatcaacttgtgccaccctgacatcgtccratctgtcatcaatacctcaggtactcctgcagagcttgtggtggtgggcacaggagaacattggagggcttctagatctcatccccaaagcttctgtgcagctcttgtagtactcagccccttccttcctgcttctctctcagccaccttcctctttccttcctgtagtcaccaaccccaacctcagtgtcttttctctctgytgcca

SEQ ID NO: 491 - DNA, 351 bp, Homo Sapiens
  allele 185: 10-9-185 : polymorphic base C or T
  misc_binding 166..184: 10-9-185.mis1
  misc_binding 186..205: 10-9-185.mis2, potential complement
  primer_bind 1..18: upstream amplification primer
  primer_bind 332..351: downstream amplification primer, complement
  misc_binding 173..197: 10-9-185 potential probe
cccttkccttgcttgcaggtcactcccacagaggagggcttgagggtcctgacccagctggtggccacctacccccagggctttgtgaggtggttgggccccatcactcccatcatcaacttgtgccaccctgacatcgtccgatctgtcatcaatacctcaggtactcctgcagagcttgtggyggtgggcacaggagaacattggagggcttctagatctcatccccaaagcttctgtgcagctcttgtagtactcagccccttccttcctgcttctctctcagccaccttcctctttccttcctgtagtcaccaaccccaacctcagtgtcttttctctctgytgcca

SEQ ID NO: 492 - DNA, 351 bp, Homo Sapiens
  allele 264: 10-9-264 : polymorphic base G or C
  misc_binding 245..263: 10-9-264.mis1
  misc_binding 265..284: 10-9-264.mis2, potential complement
  primer_bind 1..18: upstream amplification primer
  primer_bind 332..351: downstream amplification primer, complement
  misc_binding 252..276: 10-9-264 potential probe
cccttkccttgcttgcaggtcactcccacagaggagggcttgagggtcctgacccagctggtggccacctacccccagggctttgtgaggtggttgggccccatcactcccatcatcaacttgtgccaccctgacatcgtccgatctgtcatcaatacctcaggtactcctgcagagcttgtggtggtgggcacaggagaacattggagggcttctagatctcatccccaaagcttctgtgcagctcttgtagtactcagcccsttccttcctgcttctctctcagccaccttcctctttccttcctgtagtcaccaaccccaacctcagtgtcttttctctctgytgcca

SEQ ID NO: 493 - DNA, 421 bp, Homo Sapiens
  allele 22: 10-11-22 : polymorphic base C or T
  misc_binding 2..21: 10-11-22.mis1, potential
  misc_binding 23..42: 10-11-22.mis2, potential complement
  primer_bind 1..18: upstream amplification primer
  primer_bind 402..421: downstream amplification primer, complement
  misc_binding 10..34: 10-11-22 potential probe
tgttgttgcagcctagtccggycccctttatgccccccaccctcctttcttcttctgcccatggcctccttcctgctatgctgggcttggagaaaagacgtccaaacctctggctgggagccaccctccatacccaaagtccctcctctattcctctccatggaccctgatggtcctcattcatgtcagatgccattacagacaaggacatagtcttctacaagaccctgaagccctggctgggtaagtaactgtaggtggacgggacggggaccaacttttgtggccaggggaagattctgcccttgcccacagcctttggctgccgtactaggggatgggctcttgttaagtgttggtgacaagtggagacaccaccgtcgcttgctgacgcctgccttccatttcaacatcctgaagc

SEQ ID NO: 494 - DNA, 420 bp, Homo Sapiens
  allele 152: 10-13-152 : polymorphic base C or T
  misc_binding 133..151: 10-13-152.mis1
  misc_binding 153..172: 10-13-152.mis2, potential complement
  primer_bind 1..19: upstream amplification primer
  primer_bind 402..420: downstream amplification primer, complement
  misc_binding 140..164: 10-13-152 potential probe
ctgggtaagtaactgtaggtggacgggacggggacaacttttgtggccaggggaagattctgcccttgcccacagcctttggctgccgtactaggggatgggctcttgttaagtgttggtgacaagtggagacaccaccgtcgcttgctgaygcctgccttccatttcaacatcctgaagccctatataaagattttcagcaagagtgcaaacatcatgcatgtgagtgccttgaactcagcatcccagctgcagccttggggtggagggatcacatacaattgggtctggaatgttggctctcctgggtgggtttggggccattgctcttcctctctgtgccttgatttccccatgaggctaataatcctcactaaaaggtggtaggagcatgtaatggactcatgtctctgacactta

SEQ ID NO: 495 - DNA, 420 bp, Homo Sapiens
  allele 256: 10-13-256 : polymorphic base C or T
  misc_binding 237..255: 10-13-256.mis1
  misc_binding 257..276: 10-13-256.mis2, potential complement
  primer_bind 1..19: upstream amplification primer
  primer_bind 402..420: downstream amplification primer, complement
  misc_binding 244..268: 10-13-256 potential probe
ctgggtaagtaactgtaggtggacgggacggggacaacttttgtggccaggggaagattctgcccttgcccacagcctttggctgccgtactaggggatgggctcttgttaagtgttggtgacaagtggagacaccaccgtcgcttgctgacgcctgccttccatttcaacatcctgaagccctatataaagattttcagcaagagtgcaaacatcatgcatgtgagtgccttgaactcagcatcccagctgcagycttggggtggagggatcacatacaattgggtctggaatgttggctctcctgggtgggtttggggccattgctcttcctctctgtgccttgatttccccatgaggctaataatcctcactaaaaggtggtaggagcatgtaatggactcatgtctctgacactta

SEQ ID NO: 496 - DNA, 420 bp, Homo Sapiens
  allele 282: 10-13-282 : polymorphic base C or T
  misc_binding 263..281: 10-13-282.mis1
  misc_binding 283..302: 10-13-282.mis2, potential complement
  primer_bind 1..19: upstream amplification primer
  primer_bind 402..420: downstream amplification primer, complement
  misc_binding 270..294: 10-13-282 potential probe
ctgggtaagtaactgtaggtggacgggacggggacaacttttgtggccaggggaagattctgcccttgcccacagcctttggctgccgtactaggggatgggctcttgttaagtgttggtgacaagtggagacaccaccgtcgcttgctgacgcctgccttccatttcaacatcctgaagccctatataaagattttcagcaagagtgcaaacatcatgcatgtgagtgccttgaactcagcatcccagctgcagccttggggtggagggatcacatacaaytgggtctggaatgttggctctcctgggtgggtttggggccattgctcttcctctctgtgccttgatttccccatgaggctaataatcctcactaaaaggtggtaggagcatgtaatggactcatgtctctgacactta

SEQ ID NO: 497 - DNA, 428 bp, Homo Sapiens
  allele 281: 10-15-281 : polymorphic base G or T
  misc_binding 261..280: 10-15-281.mis1, potential
  misc_binding 282..301: 10-15-281.mis2, potential complement
  primer_bind 1..20: upstream amplification primer
  primer_bind 409..428: downstream amplification primer, complement
  misc_binding 269..293: 10-15-281 potential probe
tgggacagwaaaccaggagcatgcctctgggggagtccatcctggtggttggggttgcagggggactcagaggagccaaggcctggccccagccctgctcccttctctggccaggccaagtggcaacgcctggccatggagggcagcacctgtctggatgtgtttgagcacatcagccttatgaccctggacagtctgcagaaatgcatcttcagctttgacagcaattgtcaggagtgagttcttgcccagggcctgggaacatgggatggagtgggggkgtgggtgtggggagagcaaagcccagggagacaagaagagccttcctggagagatgatgagaactaggcattgaaggacaaagaaggagagaaggagagagagagagagcgagagaaagagaagtttcctccaaacaagtggaactg

SEQ ID NO: 498 - DNA, 431 bp, Homo Sapiens
  allele 142: 10-17-142 : polymorphic base C or T
  misc_binding 123..141: 10-17-142.mis1
  misc_binding 143..162: 10-17-142.mis2, potential complement
  primer_bind 1..20: upstream amplification primer
  primer_bind 413..431: downstream amplification primer, complement
  misc_binding 130..154: 10-17-142 potential probe
tgcttcctctctctggactggccctgcaggaagcccagtgaatatattactgcgatcatggagctcagtgcccttgtagtgaaacggaataaccagttcttccggtacaaggacttcctgtacttcctcactccctgtggayggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggtgggcctctctgggatctgaattcaagaggtaaaatggagcttcaggtcaaatgtcagattgaaggaccggacttgatacagagggcactaaggagccatggaaggtgctcgaagaagggagggacaagt

SEQ ID NO: 499 - DNA, 422 bp, Homo Sapiens
  allele 302: 10-18-302 : polymorphic base C or T
  misc_binding 282..301: 10-18-302.mis1, potential
  misc_binding 303..322: 10-18-302.mis2, potential complement
  primer_bind 1..19: upstream amplification primer
  primer_bind 403..422: downstream amplification primer, complement
  misc_binding 290..314: 10-18-302 potential probe
tgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggtgggcctctctgggatctgaattcaagaggtaaaatggagcttcaggtcaaatgtcagattgaaggacyggacttgatacagagggcactaaggagccatggaaggtgctcgaagaagggagggacaagtcagataaattttagaggtgattgcatagaaagcttcctgggaagaacaaacaggaggtc

SEQ ID NO: 500 - DNA, 446 bp, Homo Sapiens
  allele 331: 10-23-331 : polymorphic base A or G
  misc_binding 311..330: 10-23-331.mis1, potential
  misc_binding 332..351: 10-23-331.mis2, potential complement
  primer_bind 1..19: upstream amplification primer
  primer_bind 427..446: downstream amplification primer, complement
  misc_binding 319..343: 10-23-331 potential probe
ttcattctgcccaacctccccctcccctcaaccttcctgagagcctcaatgtatgggcgctgtccaccctctgggtgctgaagcagcccagagactcaagcctgcctggctgaccctcaggccatgacaccacggccagtggcctctcctgggtcttgtacaacctcgcgaggcacccagaataccaagaacgctgccggcaggaggtgcaagagcttctgaaggaccgtgagcctaaagagattgaatggtgagtgcaggtgctggtggctctgcctttctgcctttctgagtccttctcgttggttcttctccccaggtgggggaaaargggaggatctttttgatgattctgccattgttgcctagtgggaataggagtagagcccagaaacaggctagcaagggtaacattgcatgctttggggacagaatggtctrggagt

SEQ ID NO: 501 - DNA, 427 bp, Homo Sapiens
  allele 152: 10-25-152 : polymorphic base C or T
  misc_binding 133..151: 10-25-152.mis1
  misc_binding 153..172: 10-25-152.mis2, potential complement
  primer_bind 1..18: upstream amplification primer
  primer_bind 408..427: downstream amplification primer, complement
  misc_binding 140..164: 10-25-152 potential probe
ccaggbcaacttttcttctagtagttttgtgactttggttttctaatgcttacatctttgttgcttctggaattaattttgttataggactgagggtcagagggaggtggtgagagggtctccaggggcagcaggagggccgtgtatgctcyctggataattgttgggtgtttccttagggacgacctggcccagttgcccttcctgaccatgtgcctgaaggagagcctgcggttgcatcccccaatccctacattcgcccgcggctgcacccaggacgtggtgctcccagacagccgagtcatccccaaaggtgccctccatggcaggggaggagggtcttgggcagggcggtggtcccagcaggcagctcggaccttgtccttactgtcctctcctgcacgacagggaatgtctgttacatcaa

SEQ ID NO: 502 - DNA, 427 bp, Homo Sapiens
  allele 258: 10-25-258 : polymorphic base C or T
  misc_binding 238..257: 10-25-258.mis1, potential
  misc_binding 259..278: 10-25-258.mis2, potential complement
  primer_bind 1..18: upstream amplification primer
  primer_bind 408..427: downstream amplification primer, complement
  misc_binding 246..270: 10-25-258 potential probe
ccaggbcaacttttcttctagtagttttgtgactttggttttctaatgcttacatctttgttgcttctggaattaattttgttataggactgagggtcagagggaggtggtgagagggtctccaggggcagcaggagggccgtgtatgctccctggataattgttgggtgtttccttagggacgacctggcccagttgcccttcctgaccatgtgcctgaaggagagcctgcggttgcatcccccaatccctacattygcccgcggctgcacccaggacgtggtgctcccagacagccgagtcatccccaaaggtgccctccatggcaggggaggagggtcttgggcagggcggtggtcccagcaggcagctcggaccttgtccttactgtcctctcctgcacgacagggaatgtctgttacatcaa

SEQ ID NO: 503 - DNA, 430 bp, Homo Sapiens
  allele 103: 10-3-103 : polymorphic base C or T
  misc_binding 84..102: 10-3-103.mis1
  misc_binding 104..123: 10-3-103.mis2, potential complement
  primer_bind 1..19: upstream amplification primer
  primer_bind 411..430: downstream amplification primer, complement
  misc_binding 91..115: 10-3-103 potential probe
tcccccaatccctacattcgcccgcggctgcacccaggacgtggtgctcccagacagccgagtcatccccaaaggtgccctccatggcaggggaggagggtcytgggcagggcggtggtcccagcaggcagctcggaccttgttcttactgtcctctcctgcacgacagggaatgtctgtaacatcaacatcttcgcaatccatcacaacccctcagtctggccagaccctgaggtgctgcccctccctgtttctccatcccccgggcctggtcgggggaggggtcttgtcccggaaaaccagatactccctctctactccacccacatctgttttatgtgggggtggctgggtgtcctgagaggccccatcagcagccttaacttgcctccaccccaggtctatgaccccttccgcttcgacccagaaa

SEQ ID NO: 504 - DNA, 430 bp, Homo Sapiens
  allele 144: 10-3-144 : polymorphic base C or T
  misc_binding 125..143: 10-3-144.mis1
  misc_binding 145..164: 10-3-144.mis2, potential complement
  primer_bind 1..19: upstream amplification primer
  primer_bind 411..430: downstream amplification primer, complement
  misc_binding 132..156: 10-3-144 potential probe
tcccccaatccctacattcgcccgcggctgcacccaggacgtggtgctcccagacagccgagtcatccccaaaggtgccctccatggcaggggaggagggtcctgggcagggcggtggtcccagcaggcagctcggaccttgtycttactgtcctctcctgcacgacagggaatgtctgtaacatcaacatcttcgcaatccatcacaacccctcagtctggccagaccctgaggtgctgcccctccctgtttctccatcccccgggcctggtcgggggaggggtcttgtcccggaaaaccagatactccctctctactccacccacatctgttttatgtgggggtggctgggtgtcctgagaggccccatcagcagccttaacttgcctccaccccaggtctatgaccccttccgcttcgacccagaaa

SEQ ID NO: 505 - DNA, 430 bp, Homo Sapiens
  allele 275: 10-3-275 : polymorphic base G or T
  misc_binding 255..274: 10-3-275.mis1, potential
  misc_binding 276..294: 10-3-275.mis2, complement
  primer_bind 1..19: upstream amplification primer
  primer_bind 411..430: downstream amplification primer, complement
  misc_binding 263..287: 10-3-275 potential probe
tcccccaatccctacattcgcccgcggctgcacccaggacgtggtgctcccagacagccgagtcatccccaaaggtgccctccatggcaggggaggagggtcctgggcagggcggtggtcccagcaggcagctcggaccttgttcttactgtcctctcctgcacgacagggaatgtctgtaacatcaacatcttcgcaatccatcacaacccctcagtctggccagaccctgaggtgctgcccctccctgtttctccatcccccgggcctggtckggggaggggtcttgtcccggaaaaccagatactccctctctactccacccacatctgttttatgtgggggtggctgggtgtcctgagaggccccatcagcagccttaacttgcctccaccccaggtctatgaccccttccgcttcgacccagaaa

SEQ ID NO: 506 - DNA, 421 bp, Homo Sapiens
  allele 227: 10-5-227 : polymorphic base A or C
  misc_binding 208..226: 10-5-227.mis1
  misc_binding 228..247: 10-5-227.mis2, potential complement
  primer_bind 1..20: upstream amplification primer
  primer_bind 404..421: downstream amplification primer, complement
  misc_binding 215..239: 10-5-227 potential probe
  misc_feature 6: n=a, g, c or t
tccwtnacaacccctcagtctggccagaccctgaggtgctgcccctccctgtttctccatcccccgggcctggtcgggggaggggtcttgtcccggaaaaccagatactccctctctactccacccacatctgttttatgtgggggtggctgggtgtcctgagaggccccatcagcagccttaacttgcctccaccccaggtctatgaccccttccgcttcgacccmgaaaacgcccagaagaggtcacctatggcttttattcctttctcggcggggcccaggtgaggccagggggtgtctgaggtgggcatgggctgagggtggcacagatggctgccttgtcagatgcctgacttgtaggaccacgtgtttctgtgataggggttttaaagaagatcctaggaaaaagggtgtgctca

SEQ ID NO: 507 - DNA, 418 bp, Homo Sapiens
  allele 155: 10-7-155 : polymorphic base C or T
  misc_binding 136..154: 10-7-155.mis1
  misc_binding 156..175: 10-7-155.mis2, potential complement
  primer_bind 1..20: upstream amplification primer
  primer_bind 399..418: downstream amplification primer, complement
  misc_binding 143..167: 10-7-155 potential probe
aggctctgggaatatgcaagcccacatgggggtcccagacccagcttcccccctgtctgcccaaggtgatctgggtggggttgggggttccgggcctcgttcctggcgcagtggggccgggatctgggtcctgggtgcagtcagaccttccaccytggcccccaggaactgcatcgggcagaagttcgcgatggcagagatgaaggtggtcctggcgctcacgctgtgcgttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggc

SEQ ID NO: 508 - DNA, 418 bp, Homo Sapiens
  allele 381: 10-7-383 : polymorphic base C or T
  misc_binding 361..380: 10-7-383.mis1, potential
  misc_binding 382..401: 10-7-383.mis2, potential complement
  primer_bind 1..20: upstream amplification primer
  primer_bind 399..418: downstream amplification primer, complement
  misc_binding 369..393: 10-7-383 potential probe
aggctctgggaatatgcaagcccacatgggggtcccagacccagcttcccccctgtctgcccaaggtgatctgggtggggttgggggttccgggcctcgttcctggcgcagtggggccgggatctgggtcctgggtgcagtcagaccttccaccctggcccccaggaactgcatcgggcagaagttcgcgatggcagagatgaaggtggtcctggcgctcacgctgtgcgttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaaytaccttttcagatttccggtaataaatctgtgttggc

SEQ ID NO: 509 - DNA, 418 bp, Homo Sapiens
  allele 98: 10-7-98 : polymorphic base G or C
  misc_binding 78..97: 10-7-98.mis1, potential
  misc_binding 99..118: 10-7-98.mis2, potential complement
  primer_bind 1..20: upstream amplification primer
  primer_bind 399..418: downstream amplification primer, complement
  misc_binding 86..110: 10-7-98 potential probe
aggctctgggaatatgcaagcccacatgggggtcccagacccagcttcccccctgtctgcccaaggtgatctgggtggggttgggggttccgggcctsgttcctggcgcagtggggccgggatctgggtcctgggtgcagtcagaccttccaccctggcccccaggaactgcatcgggcagaagttcgcgatggcagagatgaaggtggtcctggcgctcacgctgtgcgttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggc

SEQ ID NO: 510 - DNA, 1001 bp, Homo Sapiens
  allele 501: 12-561-270 : polymorphic base C or T
  misc_binding 481..500: 12-561-270.mis1, potential
  misc_binding 502..520: 12-561-270.mis2, complement
  primer_bind 232..252: upstream amplification primer
  primer_bind 703..723: downstream amplification primer, complement
  misc_binding 489..513: 12-561-270 potential probe
cggcacactctcccatctgcttcctcacactttggtgcctattgttctagaatcactagacccagttacaagattatagttcaccttaactgctctttaaatagcaactcgaacattatgaaatgttgttttcactttgagatattccttcaggtcctgatatggaagaaactactgatgtcagctgaaggaccacactgatgcagctgtcctgaaggactccccgaggagctacctcatcaaaaaatacagtttccactttgcgatgattttatcccccttgccccaaccgaccagcaaccccaattttccagcccctcactctccacaatcctcttaaagccccaggccagaacttcttgggagacagatttgagggtttccttccacttccttgctgggtggcctgtgatcattaaactctttctttgctgcatccctgctgtcttagtgtaattggtctatactatgcagtgggcatgcaaacctgttgatgacccytccttgggtcatcatgaggactagaaatactggataccaagggctattctagtgcaagattgcatctcctctgtgctgtgcagagaggataatcactatctcttcaaacgcagtgtcccacatatattcaggaattcctgcaattatgagacaaatattactgtttgttgttataattatttctcaagcattatcccaccagaccaatgaaatggaagttgtagagaaaaaagtgggggacaaatctgtctgtttttgtttgtttgtttgtttgtttttgagaaagagtcttgctctgtcgcccaggctggagtgcagtggcatgatcttgcctcactgcaacctccacctcctgtattcaagtgattctccagcctcagcctcccaaggagctgggactacagacgcccgccaccatgcccagctaatttttgtagttttagtagggatggggtttcaccatgttggccaggctggtctcgaacttctgacatcaagtg

SEQ ID NO: 511 - DNA, 1001 bp, Homo Sapiens
  allele 501: 12-563-87 : polymorphic base C or T
  misc_binding 482..500: 12-563-87.mis1
  misc_binding 502..521: 12-563-87.mis2, potential complement
  primer_bind 415..433: upstream amplification primer
  primer_bind 862..882: downstream amplification primer, complement
  misc_binding 489..513: 12-563-87 potential probe
  misc_feature 151: n=a, g, c or t
gcctttattcaaaacccattgggaatgcaacagtgaacacagcaaatcttccttggcctcagggagtttatagtctagttgtcttctttagaagttggagattgagaaattggaggaatggggaaaactataccaaagataagctgaacanttgttatttgataacattgcagataatcaagtcagaaatggcctctgtctagagtagtgagtttatcggcatttatcattttcatattttttactgaacattctatcgctacagcttaatcttctttcttcatgattgtccttagcaatagaagaagggacttgagatgagccagctaagagtcatcacccacgtggccccactgccaaggctgttgtactagaaggaaatgggcattcagcccagagcagtggggccatggcttgggaactaactcctgggaggtacctaagacaaggaaacattggctctgatttaagcagatgtctgctcaagggatccaatctgayggtgggtgtatagagtaggcaacaactcagacacagtatggatttgttattacatagtgggaaggtgatctggctcaactgatcctttgcccaaggctgggatgcaggattcaggacctaggtcctaggggacaagttagatggagtacagatgagtacagggttacaaccaacggccaagggtttggactggtctccagtgctaatagaagcttggaatacaaatgtgaggctaccatagaagttgtagaataatttgtttaagtaagtaaataaataggaatagatattaaattttatcaaatgccattgcggcatttatcaggttcacttttcagtgaatgaattacattagttttccaatgtcgaaccattctgacatttgcagaataagctttacgtatgtatggtatattatgggctacctttggaattgacttgataacatttaaaatagaatttttgcatctatagtcacaagtgagtttggtttaaagttt

SEQ ID NO: 512 - DNA, 1001 bp, Homo Sapiens
  allele 501: 12-564-64 : polymorphic base G or T
  misc_binding 481..500: 12-564-64.mis1, potential
  misc_binding 502..520: 12-564-64.mis2, complement
  primer_bind 438..456: upstream amplification primer
  primer_bind 920..940: downstream amplification primer, complement
  misc_binding 489..513: 12-564-64 potential probe
ttttatttatatcctgctactattcatatacatattttatattccagaataaacatatacatgtatatgaacttcaaacagtatattttttccccatattctaccctacatcctagatttttattcaataatctaataaataataaaaatctcattatcattaaaactttttggttatgacatctgaaaatgccttttaattttgatgcatatagaattcaaaggacctgccaggtgcagtgctgtgtgcctataatctcagcttctcagaattctggctgaggcaagaggatcccttgagctcagaagttcaagaccagtctgggcaatgttgtgagaccttgtctctaaattaaaaaaaaaaattcaaaggacccaatccctttctctcagagctctataaaattgctctactttttcaatttctatttagggttgcagatgagacattcaaagccaatctgattctctttcctttgtaggtaattagacttttctttkaggtgcttataagcatttcttgttattctttgagtttagaaatatcaccaggaaatgtctatatctgtctttgtttaatcctgcctgcaacttagttagccattataatctgaagaccaacgtttttcttcagatgaagaacagttttcttcttctatttaattatttttttcatctattctgttttcttcatgaggaatggtatatgttcattctgtttcccttaggactattcttgtatgctctctttgctctcataattacatcttttgtactttttcctctgaattctgtactttcttaatctggtcctccaattgaattacatgacttgcagcagcatcagtttctagattagcaattaagtttttcatagctgaggctcctcatattctaggattgcttcctttccccataacctgcacttgttgactaatgcagtatccttttgaatttcactgagaaacttgaaacagtatgaacacatcttttaaaatatc

SEQ ID NO: 513 - DNA, 1001 bp, Homo Sapiens
  allele 501: 12-564-214 : polymorphic base C or T
  misc_binding 481..500: 12-564-214.mis1, potential
  misc_binding 502..521: 12-564-214.mis2, potential complement
  primer_bind 289..307: upstream amplification primer
  primer_bind 771..791: downstream amplification primer, complement
  misc_binding 489..513: 12-564-214 potential probe
tctcattatcattaaaactttttggttatgacatctgaaaatgccttttaattttgatgcatatagaattcaaaggacctgccaggtgcagtgctgtgtgcctataatctcagcttctcagaattctggctgaggcaagaggatcccttgagctcagaagttcaagaccagtctgggcaatgttgtgagaccttgtctctaaattaaaaaaaaaaattcaaaggacccaatccctttctctcagagctctataaaattgctctactttttcaatttctatttagggttgcagatgagacattcaaagccaatctgattctctttcctttgtaggtaattagacttttctttgaggtgcttataagcatttcttgttattctttgagtttagaaatatcaccaggaaatgtctatatctgtctttgtttaatcctgcctgcaacttagttagccattataatctgaagaccaacgtttttcttcagatgaagaacagttttyttcttctatttaattatttttttcatctattctgttttcttcatgaggaatggtatatgttcattctgtttcccttaggactattcttgtatgctctctttgctctcataattacatcttttgtactttttcctctgaattctgtactttcttaatctggtcctccaattgaattacatgacttgcagcagcatcagtttctagattagcaattaagtttttcatagctgaggctcctcatattctaggattgcttcctttccccataacctgcacttgttgactaatgcagtatccttttgaatttcactgagaaacttgaaacagtatgaacacatcttttaaaatatcttctcttccctgtagaaattccactggagactgccatgctaaggaatttatactcaatccttaaagaagtaacatgattggttctgctttttagaaacatcacttaggccttggtaggagaatagttcctagggacgctatgctagaaa

SEQ ID NO: 514 - DNA, 1001 bp, Homo Sapiens
  allele 501: 12-568-207 : polymorphic base G or T
  misc_binding 481..500: 12-568-207.mis1, potential
  misc_binding 502..521: 12-568-207.mis2, potential complement
  primer_bind 295..313: upstream amplification primer
  primer_bind 812..829: downstream amplification primer, complement
  misc_binding 489..513: 12-568-207 potential probe
atcattatctacatggagctcaaattttccatgatttgtctagtgggagccctttcaaattggctgtgttctttcaacatgacttcattattctttgagcacttctttgatttatggtataagatgctccaggctgggcatggtggcacatgcctgttgtctcagctagttgggaggttgaggtaagaggatctctttagcctgggagtttgaagtcagcctggacaacatagcaagaatcctcttaaaaaaagaaaactgaaaatgttgcaagctcatcttgtatcttccctaccccagctccagaacaaaccatttctggttccttttagtagagaataatatataaaatccacaatctggaatttagataagttcattgctattggagtgtcactactttcaggccctcttagtgggcagagttatatatatatgtgcacacacactcatttatatgtgtgtctatgtacatatgatatatacacacatacctatttktttgtctcatacacattgaaattcatgagttcataccaatacctccaattccaatctaacaccacaaggttcttcccatgtttgtaactcccttctctgacagtgagaaactctggcttcccttatctttaatttacttgtttgatcaaaccttctgtatgtaaccatcttctatcaccaccactaccccctctcctgcagatgctcctccattcctctcaagctctgacatcctgcagctcctggcccctactcttgcctccccatgtggttagtctttccttcccaaagctctgtctgctcatgctgggccatgctgccaggtagaagctcccctcaggctctgacctccctgccaagctatccatgcatcagcacctcctcagcctccttgggatccaaccgcccataccaggtcactcactcgcacgtgataccctcctacctctgctagggatcacgtacttcacaccaggccaccccttcacgtgcacaccttc

SEQ ID NO: 515 - DNA, 1001 bp, Homo Sapiens
  allele 501: 12-568-365 : polymorphic base G or T
  misc_binding 481..500: 12-568-365.mis1, potential
  misc_binding 502..521: 12-568-365.mis2, potential complement
  primer_bind 137..155: upstream amplification primer
  primer_bind 654..671: downstream amplification primer, complement
  misc_binding 489..513: 12-568-365 potential probe
gtctcagctagttgggaggttgaggtaagaggatctctttagcctgggagtttgaagtcagcctggacaacatagcaagaatcctcttaaaaaaagaaaactgaaaatgttgcaagctcatcttgtatcttccctaccccagctccagaacaaaccatttctggttccttttagtagagaataatatataaaatccacaatctggaatttagataagttcattgctattggagtgtcactactttcaggccctcttagtgggcagagttatatatatatgtgcacacacactcatttatatgtgtgtctatgtacatatgatatatacacacatacctatttttttgtctcatacacattgaaattcatgagttcataccaatacctccaattccaatctaacaccacaaggttcttcccatgtttgtaactcccttctctgacagtgagaaactctggcttcccttatctttaatttacttgtttgatcaaaccttctgkatgtaaccatcttctatcaccaccactaccccctctcctgcagatgctcctccattcctctcaagctctgacatcctgcagctcctggcccctactcttgcctccccatgtggttagtctttccttcccaaagctctgtctgctcatgctgggccatgctgccaggtagaagctcccctcaggctctgacctccctgccaagctatccatgcatcagcacctcctcagcctccttgggatccaaccgcccataccaggtcactcactcgcacgtgataccctcctacctctgctagggatcacgtacttcacaccaggccaccccttcacgtgcacaccttccttactttgggcccttaaactccatgccaagctgcccccaggcacgatgccctccatactgtgtggactttgactcctcacaccaggcagccctgcgattccaatgcccttctcaccctacttggactctgacaccctcaatcaggccctgctgcccc

SEQ ID NO: 516 - DNA, 1001 bp, Homo Sapiens
  allele 501: 12-568-367 : polymorphic base G or T
  misc_binding 481..500: 12-568-367.mis1, potential
  misc_binding 502..521: 12-568-367.mis2, potential complement
  primer_bind 135..153: upstream amplification primer
  primer_bind 652..669: downstream amplification primer, complement
  misc_binding 489..513: 12-568-367 potential probe
ctcagctagttgggaggttgaggtaagaggatctctttagcctgggagtttgaagtcagcctggacaacatagcaagaatcctcttaaaaaaagaaaactgaaaatgttgcaagctcatcttgtatcttccctaccccagctccagaacaaaccatttctggttccttttagtagagaataatatataaaatccacaatctggaatttagataagttcattgctattggagtgtcactactttcaggccctcttagtgggcagagttatatatatatgtgcacacacactcatttatatgtgtgtctatgtacatatgatatatacacacatacctatttttttgtctcatacacattgaaattcatgagttcataccaatacctccaattccaatctaacaccacaaggttcttcccatgtttgtaactcccttctctgacagtgagaaactctggcttcccttatctttaatttacttgtttgatcaaaccttctgtakgtaaccatcttctatcaccaccactaccccctctcctgcagatgctcctccattcctctcaagctctgacatcctgcagctcctggcccctactcttgcctccccatgtggttagtctttccttcccaaagctctgtctgctcatgctgggccatgctgccaggtagaagctcccctcaggctctgacctccctgccaagctatccatgcatcagcacctcctcagcctccttgggatccaaccgcccataccaggtcactcactcgcacgtgataccctcctacctctgctagggatcacgtacttcacaccaggccaccccttcacgtgcacaccttccttactttgggcccttaaactccatgccaagctgcccccaggcacgatgccctccatactgtgtggactttgactcctcacaccaggcagccctgcgattccaatgcccttctcaccctacttggactctgacaccctcaatcaggccctgctgcccctg

SEQ ID NO: 517 - DNA, 1001 bp, Homo Sapiens
  allele 501: 12-571-337 : polymorphic base G or C
  misc_binding 482..500: 12-571-337.mis1
  misc_binding 502..521: 12-571-337.mis2, potential complement
  primer_bind 165..183: upstream amplification primer
  primer_bind 647..667: downstream amplification primer, complement
  misc_binding 489..513: 12-571-337 potential probe
cctatcaggagtccctaaccccctacacgcacacacacgggcgcgcgggcgcgcacgcacacacacgcacacatgcacacatacgcgcgcgcacatgcacataggcacacagagatacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgtaagtagacctcctgctttctttccttcccttttctccctcctctaacccccttgctttcttcctgccaagtttctagacgccccagtggaggaggtttgctcttagacctcctccccttacgtcgaaatgaccgctgggtcttgcactcggaggatcttgggagccgacgtccsgacgcctcccgcccccgcagttccttggagagcttggagccgcgcgccggagggaataggaaagcttggttacaacccgggacacccggtagcttcctgcacccgggagggggctggccagggaacttgctggactgcacaactgggggagggtagaagaagaaagatcggggtggggattcgggaatgggcaagcgggcggcgggcggcgggaggcgagggtgggagcaaagggcgagcgggcaaaggccgggcgccgcgccaggccccctcctcgggcgggcgagactttcccgggacctggcccctctgcggccagaccctttccaggagggcttctggacttgtagcgagtttggaagcccagcggttgcttttttggggaaagggacaaagatgtgtgaactctaaagaagttgaactcatagaaataacgactagaatgatggttgccagaggctgggagcgggttcgggggggaatgggggcttgttggccaa

SEQ ID NO: 518 - DNA, 1001 bp, Homo Sapiens
  allele 501: 12-573-378 : polymorphic base A or G
  misc_binding 482..500: 12-573-378.mis1
  misc_binding 502..521: 12-573-378.mis2, potential complement
  primer_bind 124..144: upstream amplification primer
  primer_bind 590..610: downstream amplification primer, complement
  misc_binding 489..513: 12-573-378 potential probe
agccctgccatttactgtgtgattttgggcaagctgtgtaaactctcagaatgtaaatatttttatctgttaaaaagggattttatctttcttgtagttttcttgtaaaggtgagacaagataggatataatatatggtggatgctcaagaaatagtaatttctttcccatccccttcaagaacacaagttatctgtgaaagtgtttggagtcacaggcaaatcaaccagctcaggccctaatgcctagttccattgtgtggactagcacgttgctagagggtggctgtgagtgtctttgctgatggaaatgtttctgcactgttttgcaattcaagtacatgaaaagcagctagtgcaaataaggaactgaattttttaaatcaaatttaaagtttaaatagccacatgcgactagtaactattttatagtgcagttccacagccttagggcaggaaaacctggatatatgtatgtaattacatattataaatacaaatrtataaactataaactgaattacggtgatatcattataaaatattgatgtaaagtcttctagggtgagtagtcctttcagggaatgtggctcgccttttttctcaaatttgtagctatttatgttctcaaatatgatacaaatatttgtattttgcagtgtaatatgctacaaatatttggaatatttgtagtatattatttaccatagggctcctgacatatgtgtgacagtttgtattctggaagagttctgagatagggaaataaatagtatttacctccatacacttaattcgccatcacgcagctaattagtgtatctcaaatttgggtttcctgactcctctgtgatttgtcactgcagtgtcatgcttctacaaaattagggcctctttgtggaggcccctgcaataaagaattgatttcgggctgggtacggtggctcacacctgtaatcccagcacttcgggaggcctaggcgggtggatcacccgaggtca

SEQ ID NO: 519 - DNA, 1001 bp, Homo Sapiens; identical to SEQ ID NO: 517
  allele 501: 10-294-256 : polymorphic base G or C
  misc_binding 481..500: 10-294-256.mis1, potential
  misc_binding 502..521: 10-294-256.mis2, potential complement
  primer_bind 246..264: upstream amplification primer
  primer_bind 650..669: downstream amplification primer, complement
  misc_binding 489..513: 10-294-256 potential probe

SEQ ID NO: 520 - DNA, 1001 bp, Homo Sapiens
  allele 501: 10-294-304 : polymorphic base G or C
  misc_binding 481..500: 10-294-304.mis1, potential
  misc_binding 502..521: 10-294-304.mis2, potential complement
  primer_bind 198..216: upstream amplification primer
  primer_bind 602..621: downstream amplification primer, complement
  misc_binding 489..513: 10-294-304 potential probe
gcgcgcacgcacacacacgcacacatgcacacatacgcgcgcgcacatgcacataggcacacagagatacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgtaagtagacctcctgctttctttccttcccttttctccctcctctaacccccttgctttcttcctgccaagtttctagacgccccagtggaggaggtttgctcttagacctcctccccttacgtcgaaatgaccgctgggtcttgcactcggaggatcttgggagccgacgtcccgacgcctcccgcccccgcagttccttggagagcttggagccgcgcgcsggagggaataggaaagcttggttacaacccgggacacccggtagcttcctgcacccgggagggggctggccagggaacttgctggactgcacaactgggggagggtagaagaagaaagatcggggtggggattcgggaatgggcaagcgggcggcgggcggcgggaggcgagggtgggagcaaagggcgagcgggcaaaggccgggcgccgcgccaggccccctcctcgggcgggcgagactttcccgggacctggcccctctgcggccagaccctttccaggagggcttctggacttgtagcgagtttggaagcccagcggttgcttttttggggaaagggacaaagatgtgtgaactctaaagaagttgaactcatagaaataacgactagaatgatggttgccagaggctgggagcgggttcgggggggaatgggggcttgttggccaaagggtacgaagttcagagacgagaggagtaggttctgagatctgttgc

SEQ ID NO: 521 - DNA, 1001 bp, Homo Sapiens
  allele 501: 10-295-201 : polymorphic base G or T
  misc_binding 481..500: 10-295-201.mis1, potential
  misc_binding 502..521: 10-295-201.mis2, potential complement
  primer_bind 301..320: upstream amplification primer
  primer_bind 701..720: downstream amplification primer, complement
  misc_binding 489..513: 10-295-201 potential probe
tcactccatgtgagatgagaaacggaatggaatattcgcacttccggtaactgttcagtgccgtagagaaactctagcctagcagtggctgggaagaatttctttgttgttttatattttttccttgtcttgaagatttctttaaacctcagtttcctcatccgtacactggcaatgatactaatgtctatcttatagggaagttataaggataaaatgaggtaatctatatgaagtgcttagcacagcaccagaaacatagtaaatgttaaatgaatgtggttggcatgatatgataatgatgggatttgaggatattgtaattgtgctgtctggtctcagtttgacggctagagaactgttagaatgcagtcacttcatggcagttgactacatatttactgtgttctaggagcttcaggatggttcgtactaagacatggaccctgaagaagcactttgttggctatcctactaatagtgactttgagttgaagacakctgagctcccacccttaaaaaatggaggtaagtcatactaaaaatatttcagagttggaagggactgtatcagttagcttttgctgcataacaaactaccccaaagtttagtgactttaagcaacaacggtttattagttcacaattctttgggttggcaatttgggctgagttaagctgggtggttcttcttaggtctcatctggggtaaatggttaatttaggatgggccttgctcacatgtctgctgattagcaggctttctgttggggtgcatgccttagttctcatctatgtggcctttctagcaggctagcttgagctctattcttatagtggccccatagatctagagcagcagtagttggcaagctccaatgtgcaagcactttctctttttttttttttttttttttgagacagagtcttgctctgttgcccaggttggagtgcagtggcatgattttggctcactgcaacctctgccttctgggtccaag

SEQ ID NO: 522 - DNA, 1001 bp, Homo Sapiens
  allele 501: 10-296-80 : polymorphic base A or G
  misc_binding 481..500: 10-296-80.mis1, potential
  misc_binding 502..521: 10-296-80.mis2, potential complement
  primer_bind 423..440: upstream amplification primer
  primer_bind 833..850: downstream amplification primer, complement
  misc_binding 489..513: 10-296-80 potential probe
aggtctcaaaaaaaaaaaaaaaaaaaaagaggccggtcgcagtggctcacgcttgtaatcccagcactttaggatgccgagacgatggatcactaggtcaggagattgagaccatcctggctaacacggtgaaacccgtctctactaaaaatacaaaaaattagctgggcgttgtgaggcaggcggctgtagtcccagctactcaggaggctgaggcaggagaatggcatgaacccaggaggcggagcttccagtgagccaagatcacgccactgcactccagcctgggtgacagagcgagactccctctcaaaaaaaaaaaaaaaaaaagaatgccaaaaacgaaggcatcaggccttgagttccgtttttttcttcaacatttatgttagttttaggggtacatatgcaggcttgttatatgggtaaattgcatgtggctgaggtttggtgtacgaatgatcctgtcacccaggcagtgagcatggtacctcatgggtrgtttctcaacccttgtccctgtctcacccctcctgtctagtggtgctcagtgtctattgttcctctcaggccttgagtttctaattgcctatggaatgctttattttgtagaggtcctgcttgaagctttgttcctcaccgtggatccctacatgaggtattatttatttcgcccctcaaaatgctaatgctgtgttaaatgctatctggaagtagttcatcttctaaaatatccaactgacttaaaacattgtcactttccttctgtttctcccagccagtatcagtgataagattcatgcacgctcgtcttttgcaggcaaaggtctaagtagcttagtgagggatcacctcagtccctttgtcccaaccatctcctatctgctctgcacaatttgcctttcactgctcaacagaattacttccagaaaaaaaaaaaaaaagaaggaaaaaaaaaaccttaaaagaaaaaaataaagcctgggcaacatggcaaagcc

SEQ ID NO: 523 - DNA, 1001 bp, Homo Sapiens
  allele 501: 10-296-373 : polymorphic base A or G
  misc_binding 481..500: 10-296-373.mis1, potential
  misc_binding 502..521: 10-296-373.mis2, potential complement
  primer_bind 131..148: upstream amplification primer
  primer_bind 541..558: downstream amplification primer, complement
  misc_binding 489..513: 10-296-373 potential probe
cagagcgagactccctctcaaaaaaaaaaaaaaaaaaagaatgccaaaaacgaaggcatcaggccttgagttccgtttttttcttcaacatttatgttagttttaggggtacatatgcaggcttgttatatgggtaaattgcatgtggctgaggtttggtgtacgaatgatcctgtcacccaggcagtgagcatggtacctcatgggtggtttctcaacccttgtccctgtctcacccctcctgtctagtggtgctcagtgtctattgttcctctcaggccttgagtttctaattgcctatggaatgctttattttgtagaggtcctgcttgaagctttgttcctcaccgtggatccctacatgaggtattatttatttcgcccctcaaaatgctaatgctgtgttaaatgctatctggaagtagttcatcttctaaaatatccaactgacttaaaacattgtcactttccttctgtttctcccagccagtatcagtgatragattcatgcacgctcgtcttttgcaggcaaaggtctaagtagcttagtgagggatcacctcagtccctttgtcccaaccatctcctatctgctctgcacaatttgcctttcactgctcaacagaattacttccagaaaaaaaaaaaaaaagaaggaaaaaaaaaaccttaaaagaaaaaaataaagcctgggcaacatggcaaagccctgtctctactaaaaatacaaaaaaagtagccaggcctggtggcgcaggcctgtggtcccagctgctcagaagggtgaggcagaaagatcacttgagcctgggaggcagaggttgcagggaggcagaggttgcagcgagccaagatcttgccaccgcactccagcctaggtaacagagcaagaccccgtctcataaagaaaaaagaagccaaaccccaatttgtgcatttcactactggcaagtaatttggatagaggaagatgctaagactaaaatcagtttttctggcct

SEQ ID NO: 524 - DNA, 1001 bp, Homo Sapiens
  allele 501: 10-298-122 : polymorphic base C or T
  misc_binding 481..500: 10-298-122.mis1, potential
  misc_binding 502..521: 10-298-122.mis2, potential complement
  primer_bind 384..401: upstream amplification primer
  primer_bind 806..825: downstream amplification primer, complement
  misc_binding 489..513: 10-298-122 potential probe
gctcaggaggttgttgtgaccttagtggagtagtaggggtggaaggcaggttgcagcgggttagcacatgaatgggaagtgaagaagtttggctgaaaaaggaagacgaaggggcaaggagctaggggagggatgggattataagatggcagacttgagcatgcttatattttgagtgaaagggacagtagagaggaaaatctcaacgattctggaaagtggaaggctaagggaaagagagcgacacctgaagaagagaaggctagtgtccaggtcaccttgagccacaggacagaggcctcttgcttaaaaggaagagatgtgggtgagaacaggcgctcctcaccccatgagccactccttcctcaagtggctgggccagttgagagttctctggtgacccctatgccgatggctaagaattaagatggagaggggtggtggactatcagttgtggaatatcaacctcagtgcacttttgtcaacactaaccacacagyatcctgactcccttgaaagggaagacatgtcacatgccttaatgccttaatgtgctttatctttcagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccagggtgagtttcatggatatattccatttgtttgaatgtctgacactctgattttccaaaatggtttgttcagaacttggtcaacaggaagatatttgatgcatgataggctcaggggctgatcagagaagagggcaggaccaagatggcagatcaacctaagtgtccatcaatgggtgaatggataaagaaaacgtggtctatatacatagcagaatactatccagccttaaaaaagaagaaaatcttgtcatttgtgacaacattg

SEQ ID NO: 525 - DNA, 1001 bp, Homo Sapiens
  allele 501: 10-298-158 : polymorphic base A or G
  misc_binding 481..500: 10-298-158.mis1, potential
  misc_binding 502..521: 10-298-158.mis2, potential complement
  primer_bind 348..365: upstream amplification primer
  primer_bind 770..789: downstream amplification primer, complement
  misc_binding 489..513: 10-298-158 potential probe
gggtggaaggcaggttgcagcgggttagcacatgaatgggaagtgaagaagtttggctgaaaaaggaagacgaaggggcaaggagctaggggagggatgggattataagatggcagacttgagcatgcttatattttgagtgaaagggacagtagagaggaaaatctcaacgattctggaaagtggaaggctaagggaaagagagcgacacctgaagaagagaaggctagtgtccaggtcaccttgagccacaggacagaggcctcttgcttaaaaggaagagatgtgggtgagaacaggcgctcctcaccccatgagccactccttcctcaagtggctgggccagttgagagttctctggtgacccctatgccgatggctaagaattaagatggagaggggtggtggactatcagttgtggaatatcaacctcagtgcacttttgtcaacactaaccacacagcatcctgactcccttgaaagggaagacatgtcacatrccttaatgccttaatgtgctttatctttcagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccagggtgagtttcatggatatattccatttgtttgaatgtctgacactctgattttccaaaatggtttgttcagaacttggtcaacaggaagatatttgatgcatgataggctcaggggctgatcagagaagagggcaggaccaagatggcagatcaacctaagtgtccatcaatgggtgaatggataaagaaaacgtggtctatatacatagcagaatactatccagccttaaaaaagaagaaaatcttgtcatttgtgacaacattggaggactttatgttaagtgaaataagccaggcacag

SEQ ID NO: 526 - DNA, 1001 bp, Homo Sapiens
  allele 501: 10-300-49 : polymorphic base A or G
  misc_binding 481..500: 10-300-49.mis1, potential
  misc_binding 502..521: 10-300-49.mis2, potential complement
  primer_bind 453..470: upstream amplification primer
  primer_bind 802..820: downstream amplification primer, complement
  misc_binding 489..513: 10-300-49 potential probe
gtgagaccctgtctctgtgaaaatttaaaaaatataaggccagatgtagtggtatgcacctgtggtcccagctacttaggaggctgaggtgggaggatcacgagcttaagaggtcaaggttgcagtgagccatgttcgtgctactgcactccagcctgggcaacagagtgagaccatgtctcaaaaaaatataaacatttaaaaaatcaaaaaaggataagggggcagttactaggagggctgtctgtgatgtgggagtcacagagctgagacaaaataatagtctgaagaatgactgtaccaagagatggcatacactgcattgcaaggaagagaagcccagaaacaaagaaccaaggaagtcaaatggatcggttgtgaaaccagctggtggaactatgaaccaaataaatgcagaagggacctgctgggtggtcagaagcaagctgaagctgagttgtaggatggtccggggactgatttcacctatgggatctgttrgcccattatggtattccttttatatgtggctcagcacctaagagagtgttcctagggaacctaggcatacgagaccaggaaagtagtgttggtccatgcttgtgacttattcatggtttcctttttttttttttttctacttagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaagtacaaactggacttaatatctaatttattatggaagtactatataaagcaggagtctcctacccctgggccatggatggttagtggtccatagcctatcaggaactgggatgcacagcaggaggtgaggggcaggtgagcaagcaaagcttcatctgtatttacagcccttccccattgctcccattactgcctg

SEQ ID NO: 527 - DNA, 1001 bp, Homo Sapiens
  allele 501: 10-300-185 : polymorphic base C or T
  misc_binding 481..500: 10-300-185.mis1, potential
  misc_binding 502..521: 10-300-185.mis2, potential complement
  primer_bind 317..334: upstream amplification primer
  primer_bind 666..684: downstream amplification primer, complement
  misc_binding 489..513: 10-300-185 potential probe
cgtgctactgcactccagcctgggcaacagagtgagaccatgtctcaaaaaaatataaacatttaaaaaatcaaaaaaggataagggggcagttactaggagggctgtctgtgatgtgggagtcacagagctgagacaaaataatagtctgaagaatgactgtaccaagagatggcatacactgcattgcaaggaagagaagcccagaaacaaagaaccaaggaagtcaaatggatcggttgtgaaaccagctggtggaactatgaaccaaataaatgcagaagggacctgctgggtggtcagaagcaagctgaagctgagttgtaggatggtccggggactgatttcacctatgggatctgttggcccattatggtattccttttatatgtggctcagcacctaagagagtgttcctagggaacctaggcatacgagaccaggaaagtagtgttggtccatgcttgtgacttattcatggtttccttttttttttttttyctacttagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaagtacaaactggacttaatatctaatttattatggaagtactatataaagcaggagtctcctacccctgggccatggatggttagtggtccatagcctatcaggaactgggatgcacagcaggaggtgaggggcaggtgagcaagcaaagcttcatctgtatttacagcccttccccattgctcccattactgcctgagctccgcctcttctcagaacagtggcagcattagattcccatagaagtgtaaaccctgttgtgaactatgcatgtgagggatctaggttgtgcgttccttatggagatcgcactactcaggtgcctgatgatgcc

SEQ ID NO: 528 - DNA, 433 bp, Homo Sapiens
  allele 327: 10-10-328 : polymorphic base A or G
  misc_binding 307..326: 10-10-328.mis1, potential
  misc_binding 328..346: 10-10-328.mis2, complement
  primer_bind 1..20: upstream amplification primer
  primer_bind 414..433: downstream amplification primer, complement
  misc_binding 315..339: 10-10-328 potential probe
  misc_feature 121,412: n=a, g, c or t
attctcagggagagggctycacctcttccctgcagatccttctctctcgcagcctaggagagcatgaattgggtcctgtgtctttctctccagattcacagctcggaggaaggtctcctanacacacaaagcctggcatgcaccttcggtgatatgtgctgctggtgggtggggccctggcacgcaatcgtccgcatcttccaccccacctacatcaagcctgtgctctttgctccaggtagacactgcactggccactccaggtagacactgcactggccacgccttgcccacagctggggtctctgtgctgcctccagcgggtcrcgtgcccatgtgcagacaggaggggctgtggtggagatgccactgcttccatctcccctggacttccatctgtctgacctctgtncctgtttgctcatgtctggga

SEQ ID NO: 529 - DNA, 349 bp, Homo Sapiens
  allele 52: 10-12-52 : polymorphic base C or T
  misc_binding 32..51: 10-12-52.mis1, potential
  misc_binding 53..72: 10-12-52.mis2, potential complement
  primer_bind 1..18: upstream amplification primer
  primer_bind 330..349: downstream amplification primer, complement
  misc_binding 40..64: 10-12-52 potential probe
gagggaagaagtgcaaacctcttgctgggagcctccccccacccccaaagtycctccttcacctgcctccatggcccctgattgtcctcatttatgtcagctgccattgyaccaaaggacaaggtcttctacagcttcctgaagccctggctgggtgagtatctgcaggtgaacagggttgggaamaacctggggggccaggggagggagatgcccttgcccatggcccttggctgccctgcyaggggatgggctcctgctgagtgctggtgaaaagtggagccgccaccgtcggatctgacgcctgccttccatttcaacatcctgaagccctatatgaagattttca

SEQ ID NO: 530 - DNA, 431 bp, Homo Sapiens
  allele 46: 10-14-46 : polymorphic base C or T
  misc_binding 27..45: 10-14-46.mis1
  misc_binding 47..66: 10-14-46.mis2, potential complement
  primer_bind 1..18: upstream amplification primer
  primer_bind 414..431: downstream amplification primer, complement
  misc_binding 34..58: 10-14-46 potential probe
aaggtcttctacagcttcctgaagccctggctgggtgagtatctgyaggtgaacagggttgggaacaacctggggggccaggggagggagatgcccttgcccatggcccttggctgccctgccaggggatgggctcctgctgagtgctggtgaaaagtggagccgccaccgtcggatgtgacgcctgccttccatttcaacatcctgaagccctatatgaagattttcaatgagagtgtgaacatcatgcatgtgagttatttgaagccaaggtcccagctgcagcctttggttggggggaaccacagacagatctagtctggaattttggctctgctgggtgcctctgggccattgtcttcctctctgagctttggtttcctcatctgtaaaatccctacttaaaagaaggtcaaggtgatgtagtggag

SEQ ID NO: 531 - DNA, 419 bp, Homo Sapiens
  allele 357: 10-19-358 : polymorphic base A or G
  misc_binding 338..356: 10-19-358.mis1
  misc_binding 358..377: 10-19-358.mis2, potential complement
  primer_bind 1..18: upstream amplification primer
  primer_bind 400..419: downstream amplification primer, complement
  misc_binding 345..369: 10-19-358 potential probe
tttctgcccttatcctgcaggaarcccagtgaatatattgccgccatcttggagctcagtgcccttgtrhcaaaaagacaccaksagatcctcctghahatagacttcctgtattatctcacccctgatgggcagcgtttccgcaggcctgccgcctggtgcacgacttcacagatgccgtcatccaggagcggcgccgcacyctccctagccagggtgttgatgacttcctccaagccaaggccaaatccaagactttggacttcattgatgtactcctgctgagcaaggtgggcctctctgggatctgaattcaagaagtagaagggagcttcatgtgaaatgtcagatgaaagratttgaacttgayhcagagggcactggggagccatggaaggtgattgaggaagggagggaca

SEQ ID NO: 532 - DNA, 419 bp, Homo Sapiens
  allele 110: 10-20-111 : polymorphic base A or C
  misc_binding 91..109: 10-20-111.mis1
  misc_binding 111..130: 10-20-111.mis2, potential complement
  primer_bind 1..19: upstream amplification primer
  primer_bind 400..419: downstream amplification primer, complement
  misc_binding 98..122: 10-20-111 potential probe
  misc_feature 55..56: n=a, g, c or t
gacaaaaagacaccagcagatcctcctgtacatagacttcctgtattatctcacnnctgatgggcagcgtttccgcaggcctgccgcctggtgcacgacttcacagatgmcgtcatccaggagcggcgccgcaccctccctagccagggtgttgatgacttcctccaagccaaggccaaatccaagactttggacttcattgatgtactcctgctgagcaaggtgggcctctctgggatctgaattcaagaagtagaagggagcttcatgtgaaatgtcagatgaaagaatttgaacttgacccagagggcactggggagccatggaaggtgattgaggaagggagggacaggtcagagataggttttggagatagctctgtggactagcacctaccaggggactgctaaatrwwattg

SEQ ID NO: 533 - DNA, 419 bp, Homo Sapiens
  allele 273: 10-20-274 : polymorphic base A or G
  misc_binding 253..272: 10-20-274.mis1, potential
  misc_binding 274..292: 10-20-274.mis2, complement
  primer_bind 1..19: upstream amplification primer
  primer_bind 400..419: downstream amplification primer, complement
  misc_binding 261..285: 10-20-274 potential probe
  misc_feature 55..56: n=a, g, c or t
gacaaaaagacaccagcagatcctcctgtacatagacttcctgtattatctcacnnctgatgggcagcgtttccgcaggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggtgggcctctctgggatctgaattcaagaagtagaagggagcttcatgtgraatgtcagatgaaagaatttgaacttgacccagagggcactggggagccatggaaggtgattgaggaagggagggacaggtcagagataggttttggagatagctctgtggactagcacctaccaggggactgctaaatrwwattg

SEQ ID NO: 534 - DNA, 435 bp, Homo Sapiens
  allele 90: 10-24-90 : polymorphic base A or C
  misc_binding 71..89: 10-24-90.mis1
  misc_binding 91..110: 10-24-90.mis2, potential complement
  primer_bind 1..20: upstream amplification primer
  primer_bind 416..435: downstream amplification primer, complement
  misc_binding 78..102: 10-24-90 potential probe
tccattccaggaacagggtgggtggacccctcgcacttcccatcccccttcccccatcctccctgaggtcctcaatgcaaggttgctgtmcaccctcgggtgctgaagcagcccagagacccaagcctgccttgctgccccccaggccatgacaccacagccagtggtctctcctgggtcctgtaccaccttgcaaagcacccggaataccaggagcgctgtcggcaggaggtdcaagagcttctgaaggaccgtgagcctaaagagattgaatggtgagtgcaggtgctggtgccctgttcctgagcctgtctcattggctctgttccccaggtagggaggggagaaggggttgtttttgttgattctgccactattgcttagtgggaataggagcagaggaccacaggcaggacttagtacccatcctgactg

SEQ ID NO: 535 - DNA, 435 bp, Homo Sapiens
  allele 204: 10-24-204 : polymorphic base A or G
  misc_binding 184..203: 10-24-204.mis1, potential
  misc_binding 205..223: 10-24-204.mis2, complement
  primer_bind 1..20: upstream amplification primer
  primer_bind 416..435: downstream amplification primer, complement
  misc_binding 192..216: 10-24-204 potential probe
tccattccaggaacagggtgggtggacccctcgcacttcccatcccccttcccccatcctccctgaggtcctcaatgcaaggttgctgtacaccctcgggtgctgaagcagcccagagacccaagcctgccttgctgccccccaggccatgacaccacagccagtggtctctcctgggtcctgtaccaccttgcaaagcacccrgaataccaggagcgctgtcggcaggaggtdcaagagcttctgaaggaccgtgagcctaaagagattgaatggtgagtgcaggtgctggtgccctgttcctgagcctgtctcattggctctgttccccaggtagggaggggagaaggggttgtttttgttgattctgccactattgcttagtgggaataggagcagaggaccacaggcaggacttagtacccatcctgactg

SEQ ID NO: 536 - DNA, 435 bp, Homo Sapiens
  allele 221: 10-24-221 : polymorphic base G or T
  misc_binding 201..220: 10-24-221.mis1, potential
  misc_binding 222..241: 10-24-221.mis2, potential complement
  primer_bind 1..20: upstream amplification primer
  primer_bind 416..435: downstream amplification primer, complement
  misc_binding 209..233: 10-24-221 potential probe
tccattccaggaacagggtgggtggacccctcgcacttcccatcccccttcccccatcctccctgaggtcctcaatgcaaggttgctgtacaccctcgggtgctgaagcagcccagagacccaagcctgccttgctgccccccaggccatgacaccacagccagtggtctctcctgggtcctgtaccaccttgcaaagcacccggaataccaggagcgctktcggcaggaggtdcaagagcttctgaaggaccgtgagcctaaagagattgaatggtgagtgcaggtgctggtgccctgttcctgagcctgtctcattggctctgttccccaggtagggaggggagaaggggttgtttttgttgattctgccactattgcttagtgggaataggagcagaggaccacaggcaggacttagtacccatcctgactg

SEQ ID NO: 537 - DNA, 435 bp, Homo Sapiens
  allele 234: 10-24-234 : polymorphic base A or G
  misc_binding 214..233: 10-24-234.mis1, potential
  misc_binding 235..253: 10-24-234.mis2, complement
  primer_bind 1..20: upstream amplification primer
  primer_bind 416..435: downstream amplification primer, complement
  misc_binding 222..246: 10-24-234 potential probe
tccattccaggaacagggtgggtggacccctcgcacttcccatcccccttcccccatcctccctgaggtcctcaatgcaaggttgctgtacaccctcgggtgctgaagcagcccagagacccaagcctgccttgctgccccccaggccatgacaccacagccagtggtctctcctgggtcctgtaccaccttgcaaagcacccggaataccaggagcgctgtcggcaggaggtdcaagagcttctgaaggaccgtgagcctaaagagattgaatggtgagtgcaggtgctggtgccctgttcctgagcctgtctcattggctctgttccccaggtagggaggggagaaggggttgtttttgttgattctgccactattgcttagtgggaataggagcagaggaccacaggcaggacttagtacccatcctgactg

SEQ ID NO: 538 - DNA, 435 bp, Homo Sapiens
  allele 288: 10-24-288 : polymorphic base A or G
  misc_binding 268..287: 10-24-288.mis1, potential
  misc_binding 289..308: 10-24-288.mis2, potential complement
  primer_bind 1..20: upstream amplification primer
  primer_bind 416..435: downstream amplification primer, complement
  misc_binding 276..300: 10-24-288 potential probe
tccattccaggaacagggtgggtggacccctcgcacttcccatcccccttcccccatcctccctgaggtcctcaatgcaaggttgctgtacaccctcgggtgctgaagcagcccagagacccaagcctgccttgctgccccccaggccatgacaccacagccagtggtctctcctgggtcctgtaccaccttgcaaagcacccggaataccaggagcgctgtcggcaggaggtdcaagagcttctgaaggaccgtgagcctaaagagattgaatggtgagtgcaggtrctggtgccctgttcctgagcctgtctcattggctctgttccccaggtagggaggggagaaggggttgtttttgttgattctgccactattgcttagtgggaataggagcagaggaccacaggcaggacttagtacccatcctgactg

SEQ ID NO: 539 - DNA, 435 bp, Homo Sapiens
  allele 311: 10-24-311 : polymorphic base G or C
  misc_binding 291..310: 10-24-311.mis1, potential
  misc_binding 312..331: 10-24-311.mis2, potential complement
  primer_bind 1..20: upstream amplification primer
  primer_bind 416..435: downstream amplification primer, complement
  misc_binding 299..323: 10-24-311 potential probe
tccattccaggaacagggtgggtggacccctcgcacttcccatcccccttcccccatcctccctgaggtcctcaatgcaaggttgctgtacaccctcgggtgctgaagcagcccagagacccaagcctgccttgctgccccccaggccatgacaccacagccagtggtctctcctgggtcctgtaccaccttgcaaagcacccggaataccaggagcgctgtcggcaggaggtdcaagagcttctgaaggaccgtgagcctaaagagattgaatggtgagtgcaggtgctggtgccctgttcctgagcctstctcattggctctgttccccaggtagggaggggagaaggggttgtttttgttgattctgccactattgcttagtgggaataggagcagaggaccacaggcaggacttagtacccatcctgactg

SEQ ID NO: 540 - DNA, 419 bp, Homo Sapiens
  allele 289: 10-26-289 : polymorphic base G or C
  misc_binding 269..288: 10-26-289.mis1, potential
  misc_binding 290..309: 10-26-289.mis2, potential complement
  primer_bind 1..18: upstream amplification primer
  primer_bind 400..419: downstream amplification primer, complement
  misc_binding 277..301: 10-26-289 potential probe
gagaaaaggtctcacttgcaaacagagagaagctggagadttgtgtctttgctcccttgataaggattggggctggggtgtttccttagggacgacctggcccatttgcccttcctgaccatgtgcattaaggagagcctgaggctgcatcccccagtcccggycrtctctcgctattgcacccaagacattgtgctcccagacggccgggtcatccccaaaggtgchaaagcctcagggggaggagcctcctgggtaggaagaggggcccctcaggcagggagccttstcctgactgcccccttctctcccacaggcattatctgcctcatcagtgtttttggaacccatcacaacccagcygtgtggccggaccctgaggtgcggccccccgtctctgtttttgtccattccaaggc

SEQ ID NO: 541 - DNA, 446 bp, Homo Sapiens
  allele 39: 10-8-39 : polymorphic base A or C
  misc_binding 20..38: 10-8-39.mis1
  misc_binding 40..59: 10-8-39.mis2, potential complement
  primer_bind 1..20: upstream amplification primer
  primer_bind 427..446: downstream amplification primer, complement
  misc_binding 27..51: 10-8-39 potential probe
aactgctctaggtggggttgggtgtcccaggccaggttmccggcttgatggggccaggatggggctcctgggtgcagtcagagttcccacctccctcccctaggaactgcatcgggcagdcgttcgcgatggcggagatgaaggtggtcctggggctcacgctgctggcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgavgcctagaattaccctaagaccctgttccacagtcctgtattccatcctagatatctactcaaaataattgagacaagtgttcaaacagaaagacgcttgtgcgtgaatgttcatggcagc

SEQ ID NO: 542 - DNA, 446 bp, Homo Sapiens
  allele 120: 10-8-120 : polymorphic base A or G
  misc_binding 100..119: 10-8-120.mis1, potential
  misc_binding 121..140: 10-8-120.mis2, potential complement
  primer_bind 1..20: upstream amplification primer
  primer_bind 427..446: downstream amplification primer, complement
  misc_binding 108..132: 10-8-120 potential probe
aactgctctaggtggggttgggtgtcccaggccaggttaccggcttgatggggccaggatggggctcctgggtgcagtcagagttcccacctccctcccctaggaactgcatcgggcagdcgttcgcgatggcggagatgaaggtggtcctggggctcacgctgctggcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgavgcctagaattaccctaagaccctgttccacagtcctgtattccatcctagatatctactcaaaataattgagacaagtgttcaaacagaaagacgcttgtgcgtgaatgttcatggcagc

SEQ ID NO: 543 - DNA, 446 bp, Homo Sapiens
  allele 154: 10-8-154 : polymorphic base G or C
  misc_binding 134..153: 10-8-154.mis1, potential
  misc_binding 155..174: 10-8-154.mis2, potential complement
  primer_bind 1..20: upstream amplification primer
  primer_bind 427..446: downstream amplification primer, complement
  misc_binding 142..166: 10-8-154 potential probe
aactgctctaggtggggttgggtgtcccaggccaggttaccggcttgatggggccaggatggggctcctgggtgcagtcagagttcccacctccctcccctaggaactgcatcgggcagdcgttcgcgatggcggagatgaaggtggtcctggsgctcacgctgctggcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgavgcctagaattaccctaagaccctgttccacagtcctgtattccatcctagatatctactcaaaataattgagacaagtgttcaaacagaaagacgcttgtgcgtgaatgttcatggcagc

SEQ ID NO: 544 - DNA, 446 bp, Homo Sapiens
  allele 101: 10-8-101 : polymorphic base A or T
  misc_binding 81..100: 10-8-101.mis1, potential
  misc_binding 102..119: 10-8-101.mis2, complement
  primer_bind 1..20: upstream amplification primer
  primer_bind 427..446: downstream amplification primer, complement
  misc_binding 89..113: 10-8-101 potential probe
aactgctctaggtggggttgggtgtcccaggccaggttaccggcttgatggggccaggatggggctcctgggtgcagtcagagttcccacctccctccccwaggaactgcatcgggcagdcgttcgcgatggcggagatgaaggtggtcctggggctcacgctgctggcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgavgcctagaattaccctaagaccctgttccacagtcctgtattccatcctagatatctactcaaaataattgagacaagtgttcaaacagaaagacgcttgtgcgtgaatgttcatggcagc

SEQ ID NO: 545 - DNA, 446 bp, Homo Sapiens
  allele 86: 10-8-86 : polymorphic base C or T
  misc_binding 67..85: 10-8-86.mis1
  misc_binding 87..106: 10-8-86.mis2, potential complement
  primer_bind 1..20: upstream amplification primer
  primer_bind 427..446: downstream amplification primer, complement
  misc_binding 74..98: 10-8-86 potential probe
aactgctctaggtggggttgggtgtcccaggccaggttaccggcttgatggggccaggatggggctcctgggtgcagtcagagttyccacctccctcccctaggaactgcatcgggcagdcgttcgcgatggcggagatgaaggtggtcctggggctcacgctgctggcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgavgcctagaattaccctaagaccctgttccacagtcctgtattccatcctagatatctactcaaaataattgagacaagtgttcaaacagaaagacgcttgtgcgtgaatgttcatggcagc

SEQ ID NO: 546 - DNA, 446 bp, Homo Sapiens
  allele 92: 10-8-92 : polymorphic base C or T
  misc_binding 72..91: 10-8-92.mis1, potential
  misc_binding 93..112: 10-8-92.mis2, potential complement
  primer_bind 1..20: upstream amplification primer
  primer_bind 427..446: downstream amplification primer, complement
  misc_binding 80..104: 10-8-92 potential probe
aactgctctaggtggggttgggtgtcccaggccaggttaccggcttgatggggccaggatggggctcctgggtgcagtcagagttcccaccyccctcccctaggaactgcatcgggcagdcgttcgcgatggcggagatgaaggtggtcctggggctcacgctgctggcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgavgcctagaattaccctaagaccctgttccacagtcctgtattccatcctagatatctactcaaaataattgagacaagtgttcaaacagaaagacgcttgtgcgtgaatgttcatggcagc

SEQ ID NO: 547 - DNA, 446 bp, Homo Sapiens
  allele 94: 10-8-94 : polymorphic base C or T
  misc_binding 74..93: 10-8-94.mis1, potential
  misc_binding 95..114: 10-8-94.mis2, potential complement
  primer_bind 1..20: upstream amplification primer
  primer_bind 427..446: downstream amplification primer, complement
  misc_binding 82..106: 10-8-94 potential probe
aactgctctaggtggggttgggtgtcccaggccaggttaccggcttgatggggccaggatggggctcctgggtgcagtcagagttcccacctcyctcccctaggaactgcatcgggcagdcgttcgcgatggcggagatgaaggtggtcctggggctcacgctgctggcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgavgcctagaattaccctaagaccctgttccacagtcctgtattccatcctagatatctactcaaaataattgagacaagtgttcaaacagaaagacgcttgtgcgtgaatgttcatggcagc

SEQ ID NO: 548 - DNA, 1001 bp, Homo Sapiens
  allele 501: 12-61-472 : polymorphic base C or T
  misc_binding 481..500: 12-61-472.mis1, potential
  misc_binding 502..521: 12-61-472.mis2, potential complement
  primer_bind 39..57: upstream amplification primer
  primer_bind 548..568: downstream amplification primer, complement
  misc_binding 489..513: 12-61-472 potential probe
  misc_feature 337: n=a, g, c or t
ctggcagccttccctgcccccaccaccagtgagccacttaatgatttgtgacatcccaaagtcccgaactgtcttgtcaccccagtcactggttcaggcccttccttgcccctccttctagagaaagagccctccagctcacctcagagaagatacaagatccctacagacaccattgtagggaccagccccacagggtcggtgggtctctccctgtgtgcgacgacgagagagtgtagaaataaagacacaagacaaagagataagagaaaaggcagctgggcccgggggaccactaccaccaatgcgcggagaccggtagtggccccgaatgtcnggctgcgctgttatttattggatacaaggcagaaggggcaaggtaaagaatgtgagtcacctccaatgataggtaaggtcatgtgggtcacatatccactggacagggggcccttccctgcctggcagccgaggcagagagggagaggagacaaagagaaagayagcttacaccattatttctgcatatcagggactattagtattttcactaatttactactgctatctggaaggcagagccaggtgtacaggatggaacatgaaggtggactaggagcgtgaccactgaagcacagcatcacagggagacggttaggcctccggataactgtgggtgagcctgactgatgtcagggcctccacaagaggtggaggagcagagtcttctctaaactcccccggggaaagggagacccccccccccccaccccgctttcccggtctgctaagtagctggtgttgtttcttgacaccttttgctaccgctggaccatgatccgcttggtgacgggcgtcttcccagatgctggcgtcaccgctagaccaaggagccctctggtggccctgtccaggcataacagaaggctcgcactcctgtcttctggtcacttctcactatgtcccctcagctcctatctctgtatggcctggtttttcctagg

SEQ ID NO: 549 - DNA, 472 bp, Homo Sapiens
  allele 416: 12-63-402 : polymorphic base A or G
  misc_binding 396..415: 12-63-402.mis1, potential
  misc_binding 417..436: 12-63-402.mis2, potential complement
  primer_bind 15..35: upstream amplification primer
  primer_bind 445..464: downstream amplification primer, complement
  misc_binding 404..428: 12-63-402 potential probe
  misc_feature 13..14: n=a, g, c or t
atctcttagtccnnttgactccagtttcttattcctttaatgtattttctacatctttatgagtaatagttctaaaacgcaaacatggttcaatcagtctcctgcttaaagacacttttaaataattctaatgagctcaataaaggtcagagccctgagcaggacaagaataatacagtgggtctgaagtttagaaaggaaatgaggctgagatttgggagttagcaagtaaatgatcattaaaaccatgaatggagagggtacaccctgagaagagaagtagacataaatagtactttaaagaatgctaacaaggggaaaggaggagaacaaaggaagtgtgtagtattatgaaaactgaagatatattaacaagggggttttttggtgaactggacaaggccagtttcaatagrgctgtgagggcagaaatcagaccagagtggtttgagggatgagtggaagttaaaaa

SEQ ID NO: 550 - DNA, 472 bp, Homo Sapiens
  allele 88: 12-63-74 : polymorphic base A or G
  misc_binding 68..87: 12-63-74.mis1, potential
  misc_binding 89..108: 12-63-74.mis2, potential complement
  primer_bind 15..35: upstream amplification primer
  primer_bind 445..464: downstream amplification primer, complement
  misc_binding 76..100: 12-63-74 potential probe
  misc_feature 13..14: n=a, g, c or t
atctcttagtccnnttgactccagtttcttattcctttaatgtattttctacatctttatgagtaatagttctaaaacgcaaacatgrttcaatcagtctcctgcttaaagacacttttaaataattctaatgagctcaataaaggtcagagccctgagcaggacaagaataatacagtgggtctgaagtttagaaaggaaatgaggctgagatttgggagttagcaagtaaatgatcattaaaaccatgaatggagagggtacaccctgagaagagaagtagacataaatagtactttaaagaatgctaacaaggggaaaggaggagaacaaaggaagtgtgtagtattatgaaaactgaagatatattaacaagggggttttttggtgaactggacaaggccagtttcaatagggctgtgagggcagaaatcagaccagagtggtttgagggatgagtggaagttaaaaa

SEQ ID NO: 551 - DNA, 787 bp, Homo Sapiens
  allele 287: 12-64-271 : polymorphic base C or T
  misc_binding 268..286: 12-64-271.mis1
  misc_binding 288..307: 12-64-271.mis2, potential complement
  primer_bind 19..38: upstream amplification primer
  primer_bind 407..425: downstream amplification primer, complement
  misc_binding 275..299: 12-64-271 potential probe
  misc_feature 6,91..92,424,457: n=a, g, c or t
tgaggntggccttcacccacagttggcagcaaacgcagtgctgttcctgtgcgggaacgtggcaggagtgtaccacaaggcgctgatgganngcgccctgcgggccacgttccgggaggcactcagctccctgcactcacgccggcggctggacaccgagaagaagcaccaggtcagccgggcctaggaaggtcagagcagcgctccgagggaggagttgcttagattacataacggggctcctccacaagttgagtgactctgggcaggtttcttgacctgtttcytcttttgtataaaatgtgggtattgcccatcttagaaggttgtgaggctcaaacaaaccaaagcttataaaaagcactttagagcattatgatattaagtgaactcccattcaggtgttgatactgggagtttagtncactaaaggtgatcagtgtaggatggagtgctnggggccctgctgtgtgcagcgggaggacctgggggagcaccctggggagcacctaggatgggcagtgtgggctcctgagtgatttgggggacagggcctcctggctttagggtgcagaagagttggtgttcatggtgacctcttccaggaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcaggtatgaggaagaatggctggaggggaggggcct

SEQ ID NO: 552 - DNA, 939 bp, Homo Sapiens
  allele 439: 12-65-98 : polymorphic base C or T
  misc_binding 419..438: 12-65-98.mis1, potential
  misc_binding 440..459: 12-65-98.mis2, potential complement
  primer_bind 342..360: upstream amplification primer
  primer_bind 777..797: downstream amplification primer, complement
  misc_binding 427..451: 12-65-98 potential probe
cctgcaggtcgactctagaggatcctggagccagactgcctggctacaaatcctagctttgccacttgcttgtcccagtgtgacctggggcaagttacttaacttctgtattgcgtttcctctatgtctgaatttcttcaacagtaacataggaaaaatattatctagctgctgcagttgaagttaatctgttgaagttaagctgaaataaaagaatctatgtaaagtgcttagaatagtgtctgtactaagtaagggctcagtatagtaataggaagctgaggctcagaaagattaagtaacttgttgagggccacccatgtaataagtggccaaatgggacctgtgtctagtctggtccagccctcccacctcaccaccagccttcttttgttggtggtcacctccttctctagcttcctgctctgtgcacactcayaggcgcaaccagatacttgggaacacagatgccctcaagtgcagatttgccaggtacagccttgcatcatagtcactaatcacattgtgattagcaatcttgaaactgggaaggttgagtcaagcaggcttaagagaggaagtgagtctcatgaaaaaatctgcatcagagaaggcagggcttgagttttggaaagagcgggcaggaagggtatttcaggtatgtaatatgacgtgaaggtgggggagagaaagccaaactaacttagctggctggcacagagaggctgagccaggtgcctttggagataagagcagtggaactgatgataataagcctcttgcttgaaggcaaaaggagttgtcaggagttatatttggcctcctatgtgggataagtgggaaccatgcaggtgtctgagagccacaatcttttttttttttttttgagacggagtctcgttctgtcacccacgctggagtagtggtgcggtgtctgct

SEQ ID NO: 553 - DNA, 1001 bp, Homo Sapiens
  allele 501: 12-70-147 : polymorphic base A or C
  misc_binding 482..500: 12-70-147.mis1
  misc_binding 502..521: 12-70-147.mis2, potential complement
  primer_bind 355..374: upstream amplification primer
  primer_bind 784..804: downstream amplification primer, complement
  misc_binding 489..513: 12-70-147 potential probe
  misc_feature 871,905,946: n=a, g, c or t
ggagggaggtccctagtgatggcactttttcagtgacgtgggatgagcacagatgccactctcataatcgaaggtcacttgcacataattgggaggaatactggatgatggcgtctggtgagattgttgggccagatttgtcatgtggtattgaatagggacagaattacactctggttctttggtcttcagataatcagctgcacaagagtgagatacgtgaggggtggaataacgatagtgtatgaagacaggaggactctggctgataagagattggaaagaattgactgtgatctgcttgccaaaagcactaacgtgactttgggatgcactaagagagctttagtacccagaacaatggggctcataggccccagactctgtgagagtcaaaccctgtgaggagtgtgtggcccattttgagagggacagagacaaactgtagagtccagaggtagaaatcaggatggtgagaagagcccatgaccacagggaagmcatgaagatactgaactgggagagaagattcaaggggcagatgataatggtctttcaactcctggaatagaaaccgaattgattctgcatatcttgagagcaaagaccaaagaccagagagtggatgtagatcctttatgaggaaggactttctaataattaaagctaattattctaccaaaggtagaatgggcctcaatgagaggtgggaggcattcaagcatatgttggtcaaccactttgtgagaatgtagtagtggacattcagagaccagagtctctccactctgaagttctgaaagatgctgatccctgggatggagcaggggactagagtaactcaagagcccaagaagatcctctccactgncccattccccacaactgaccattccttggacacnttggtttgaatgcttgcattctttctcttctccctgctccnccagttccttctgagtcaggctggggaaattgcttgatggcccatgggggttgcc

SEQ ID NO: 554 - DNA, 1001 bp, Homo Sapiens
  allele 501: 12-70-397 : polymorphic base C or T
  misc_binding 482..500: 12-70-397.mis1
  misc_binding 502..521: 12-70-397.mis2, potential complement
  primer_bind 105..124: upstream amplification primer
  primer_bind 534..554: downstream amplification primer, complement
  misc_binding 489..513: 12-70-397 potential probe
  misc_feature 621,655,696: n=a, g, c or t
acaggaggactctggctgataagagattggaaagaattgactgtgatctgcttgccaaaagcactaacgtgactttgggatgcactaagagagctttagtacccagaacaatggggctcataggccccagactctgtgagagtcaaaccctgtgaggagtgtgtggcccattttgagagggacagagacaaactgtagagtccagaggtagaaatcaggatggtgagaagagcccatgaccacagggaagccatgaagatactgaactgggagagaagattcaaggggcagatgataatggtctttcaactcctggaatagaaaccgaattgattctgcatatcttgagagcaaagaccaaagaccagagagtggatgtagatcctttatgaggaaggactttctaataattaaagctaattattctaccaaaggtagaatgggcctcaatgagaggtgggaggcattcaagcatatgttggtcaaccactttgtgagaaygtagtagtggacattcagagaccagagtctctccactctgaagttctgaaagatgctgatccctgggatggagcaggggactagagtaactcaagagcccaagaagatcctctccactgncccattccccacaactgaccattccttggacacnttggtttgaatgcttgcattctttctcttctccctgctccnccagttccttctgagtcaggctggggaaattgcttgatggcccatgggggttgccacgtgcctgtagcacacttcctggctggggaagaagacgaaacaggttagccagtgagaagggagggcaggtccccaaggttgccctaaaagacagaagggccccagagggaaagtccccacaagagcattctaactctcccagggtgtggtgggtactgactcaggttggcgtctcttggggaagagttgagggaaaagcaaccaagaaatggtgttgaaaagctggaaaaacttcttgagccagccag

SEQ ID NO: 555 - DNA, 1001 bp, Homo Sapiens
  allele 501: 12-71-320 : polymorphic base A or G
  misc_binding 481..500: 12-71-320.mis1, potential
  misc_binding 502..520: 12-71-320.mis2, complement
  primer_bind 187..206: upstream amplification primer
  primer_bind 703..721: downstream amplification primer, complement
  misc_binding 489..513: 12-71-320 potential probe
ttggcggggctgtgtgaaatgaatgaggtgatgtagtgcaactgtattttgcatgaaatggagttaagactgcctgatgcccttcttgtccctagtcccctactgctatttctccgagatcagacgagttccagactcctggagcaggtcctgctggtgttggagcccccaagactccagagcctctttgaggagcacttgcaggggcagctgcagaccctggctgcacatcccattgccaacttccctttgcagcgcttactggatgcagtcactacccctgagctggtgagttggaaacctgagctggatctgtttctgctaattcttgatcactggaccttattttatggtctgtctgcctctatatacctttgacattgtgctggccattgcccttgaaaagctattctttgaggttttccagagcttaggataaaggtgcccaccttctagtgaggatttgttttgacttctctcaggtatgaggaccagcaagaractggctttattcaggtttacagcttgaggttccatggcccacccagactctggtacttggctataagcccacatgagtgctagagctgttgccatagcttctcttttcctttgctgcttaggactaaggtgggcttccctgtggtctcatgcattgggtgttagagtggaagtgcagtttaattttagtctccccttgctcctagtgctcccttacacatagggaagagccacttaaagttccttcctgtgaggtggcacctctaagactgcccccttatcctgggccttatctagccaaacaaaagtcctgatactggcaatgctttttatgttttatctagcatttttagttgttttcgttgggaagatttctctgaataatgtggtccgccattaccagaatgccagagttacattccatgtttcccatcagctgtcccctgtgtttgaggagctgagccctgtcttggaagctgtattggcccagggccacccag

SEQ ID NO: 556 - DNA, 1001 bp, Homo Sapiens
  allele 501: 12-73-150 : polymorphic base C or T
  misc_binding 481..500: 12-73-150.mis1, potential
  misc_binding 502..521: 12-73-150.mis2, potential complement
  primer_bind 353..370: upstream amplification primer
  primer_bind 799..818: downstream amplification primer, complement
  misc_binding 489..513: 12-73-150 potential probe
  misc_feature 107: n=a, g, c or t
gtgagtggatattacccacaatctgtttatgccctcagttcaacttctaccttttaggacttatctaatcttaagtttttgtacctctggactcaggaagtctaatngcccaaggagttcacaggaatgggggaaaatgaggcctatagtgcccgccaccatacccagctaattttttttttttttttgagacggagttttgctcttgttgcccaggctggagtgcagtggcgcaatctcagctcaccgtgcccggctgaggccaaatgttatttcacagtcctggaacaaaaattgtctcccagaactaagagagaagtttatttaagggataaacatttattaacccctgtatgtgatagaggctggggatacagcaaggcatgacatctgctttcatggagctatcattcttgtggagttgggccttctttcctttcctgaaggtgttcccttaaagttgaggtaagggacggagaagttctcaggttcatcatattytgtcttctcctttaggcattccactgtgcagagccctcatcccggcaagtggcctgtgtgcctctctttgccactttgatggcttatgaggtgtactatggactgacggaggaggagggggcagtgcctgcagagcaccaggtgaggtaggggagaggccaagccagtgactaattgggagtcaggcctcccagggtttagcaagcgtctgacttctgaggtgagagtggtgacttcatccaggtggaggtggcagtgttctggggatgggctcatccacctggcttgttggtgcctcctaatttcttatctctgcgctgccaggtggcaatggccgcagccagagccttgggggatgtgacagtccttgggtctctactgctccagcatctgctgcacttctccactcctggtcttgtacttcgaagtctgggtgccttgacgggaccacagcttctgtcccttgcccaaagtcccgctggctctcatgtgctcgatgc

SEQ ID NO: 557 - DNA, 1001 bp, Homo Sapiens
  allele 501: 12-73-49 : polymorphic base A or G
  misc_binding 482..500: 12-73-49.mis1
  misc_binding 502..521: 12-73-49.mis2, potential complement
  primer_bind 453..470: upstream amplification primer
  primer_bind 899..918: downstream amplification primer, complement
  misc_binding 489..513: 12-73-49 potential probe
  misc_feature 207: n=a, g, c or t
tgtattggcccagggccacccaggggtagtcattgccctggtgggggcctgtcgcagagttggggcctaccaagccaaggtcctacagctcttgttggaggtgagtggatattacccacaatctgtttatgccctcagttcaacttctaccttttaggacttatctaatcttaagtttttgtacctctggactcaggaagtctaatngcccaaggagttcacaggaatgggggaaaatgaggcctatagtgcccgccaccatacccagctaattttttttttttttttgagacggagttttgctcttgttgcccaggctggagtgcagtggcgcaatctcagctcaccgtgcccggctgaggccaaatgttatttcacagtcctggaacaaaaattgtctcccagaactaagagagaagtttatttaagggataaacatttattaacccctgtatgtgatagaggctggggatacagcaaggcatgacatctgctttcatrgagctatcattcttgtggagttgggccttctttcctttcctgaaggtgttcccttaaagttgaggtaagggacggagaagttctcaggttcatcatattttgtcttctcctttaggcattccactgtgcagagccctcatcccggcaagtggcctgtgtgcctctctttgccactttgatggcttatgaggtgtactatggactgacggaggaggagggggcagtgcctgcagagcaccaggtgaggtaggggagaggccaagccagtgactaattgggagtcaggcctcccagggtttagcaagcgtctgacttctgaggtgagagtggtgacttcatccaggtggaggtggcagtgttctggggatgggctcatccacctggcttgttggtgcctcctaatttcttatctctgcgctgccaggtggcaatggccgcagccagagccttgggggatgtgacagtccttgggtctctactgctccagcatctgctgcact

SEQ ID NO: 558 - DNA, 1001 bp, Homo Sapiens
  allele 501: 12-73-56 : polymorphic base A or T
  misc_binding 481..500: 12-73-56.mis1, potential
  misc_binding 502..521: 12-73-56.mis2, potential complement
  primer_bind 446..463: upstream amplification primer
  primer_bind 892..911: downstream amplification primer, complement
  misc_binding 489..513: 12-73-56 potential probe
  misc_feature 200: n=a, g, c or t
gcccagggccacccaggggtagtcattgccctggtgggggcctgtcgcagagttggggcctaccaagccaaggtcctacagctcttgttggaggtgagtggatattacccacaatctgtttatgccctcagttcaacttctaccttttaggacttatctaatcttaagtttttgtacctctggactcaggaagtctaatngcccaaggagttcacaggaatgggggaaaatgaggcctatagtgcccgccaccatacccagctaattttttttttttttttgagacggagttttgctcttgttgcccaggctggagtgcagtggcgcaatctcagctcaccgtgcccggctgaggccaaatgttatttcacagtcctggaacaaaaattgtctcccagaactaagagagaagtttatttaagggataaacatttattaacccctgtatgtgatagaggctggggatacagcaaggcatgacatctgctttcatggagctawcattcttgtggagttgggccttctttcctttcctgaaggtgttcccttaaagttgaggtaagggacggagaagttctcaggttcatcatattttgtcttctcctttaggcattccactgtgcagagccctcatcccggcaagtggcctgtgtgcctctctttgccactttgatggcttatgaggtgtactatggactgacggaggaggagggggcagtgcctgcagagcaccaggtgaggtaggggagaggccaagccagtgactaattgggagtcaggcctcccagggtttagcaagcgtctgacttctgaggtgagagtggtgacttcatccaggtggaggtggcagtgttctggggatgggctcatccacctggcttgttggtgcctcctaatttcttatctctgcgctgccaggtggcaatggccgcagccagagccttgggggatgtgacagtccttgggtctctactgctccagcatctgctgcacttctccac

SEQ ID NO: 559 - DNA, 1001 bp, Homo Sapiens
  allele 501: 12-74-38 : polymorphic base G or A
  misc_binding 502..520: 12-74-38.mis1, complement
  misc_binding 481..500: 12-74-38.mis2, potential
  primer_bind 519..538: upstream amplification primer, complement
  primer_bind 88..106: downstream amplification primer
  misc_binding 489..513: 12-74-38 potential probe
aggaggatggaaaggatggtcccacggagaccctggaggagctggtcctgggactagccgctgaggtgtgtgatgattttcttgtctactgtggagacacacatggcagcttcgtggtcagaactctgcttcaggtgttaggagggactattctggagtctgagagagccaggccccgtggttcccaatcatctggtaagtattacaagaggaaagtggacctagggggaagaagaatttagaaagttcagaatgagacagtaaacagaagagtaagtcttcatgggggagcttgaccgggaagaattagcttgacctgtcctaatctgaacagggcttagcaagccaaagattagtgtgtgcggaggcccagaggtagggatgtacagttgtgtttggggaaggctattagaatggacgcaggaggagaattttttttaagcatgacttaatatacaaatggacttaagcaaaagtaacatacacactggactcaagcaraagttcaggaaactatacccttactacatgcagcccactctgttatttttttttccttttcaaaactattctgctctatttcatttaaaaaaaatgctagttgagaccactaacttgatttcatggtacagtcttgagctgtgatccacattttgaaaaactaggaaataaagttagcgagtttaaatgaggctttattttggaatggcttgaatacctggctgaggaggttgaactgtcttctgtggaccatggggaagctggttgaagtttcttagaaaaattaagacagaaatgtagtctcagttcagtcatccagaagagacatttagttgtactacatctgttctgcatctccaagcggaatccttgttcatctgtgaaatttttctctcctggatggcagtttgtgatctccccactgcacatgttcttaatcttccttcagaagcacagaagaccccagctcaggaatgtaagccagctgattttgaagtccc

SEQ ID NO: 560 - DNA, 1001 bp, Homo Sapiens
  allele 501: 12-76-238 : polymorphic base G or T
  misc_binding 481..500: 12-76-238.mis1, potential
  misc_binding 502..520: 12-76-238.mis2, complement
  primer_bind 264..283: upstream amplification primer
  primer_bind 671..689: downstream amplification primer, complement
  misc_binding 489..513: 12-76-238 potential probe
gtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaaccttgtgagtggggtacatgtgctgtgggtatcggggtgctcgtgggcgccctggtggggcccctctcggtagttgagagtcacgtcctttagttccccatgatttacaattttggaagggacacaaagaaacatagactkcccccatcccagatgattccgagtacatagtctgcagataatacttagcaaaacgcagtctacagactcctaaagcagcttgtctaggaagaccacccatgtgggcttatcactccaggttctgtgacccgggaccttctgagaaaacagcactgctgtgaaatatcttccttgaagcctgtgataagtctccttgttagaatgactccaacttcctgccaataatctttgtcctctccataggagatgttctaggggatgccttccttccctccatttcacaaagaggccagacttgaggactaagtcattagatcttatcccttagaattttgcatatcagcatctgctaacctccacaacacaccctggcacagggtggggctgagggccccaggaaacaaagattcccaaaagtgagagggatgagtcattatttcctagagatgactgttgttttagagaaccttggtccaactctgttctgacaaggttttagg

SEQ ID NO: 561 - DNA, 822 bp, Homo Sapiens
  allele 501: 12-77-217 : polymorphic base C or T
  misc_binding 481..500: 12-77-217.mis1, potential
  misc_binding 502..521: 12-77-217.mis2, potential complement
  primer_bind 288..306: upstream amplification primer
  primer_bind 772..792: downstream amplification primer, complement
  misc_binding 489..513: 12-77-217 potential probe
  misc_feature 18: n=a, g, c or t
aaaaaaaaaattttaatnaaaaatgaagatagattccaacaggaagtcaggtacagaaagcagtcacttcaatgtaatgtgaatatggtaaattataagagggagatatgcacagaatactctaggggtgttggggagcatccagatgacataggagagtggctagggaaagtggtttgggaaagcgtcctggaggaggtaggtggttcttgaactgagttttgaaaggtaagaattaggtaaaggaagttaggaaaagcattccagcagagggagctccataagcatagggacgctgtgtgaaagagtagatgtgtgagataatgcaagggaagagtagtgagtgagaggctggagaggaaagagtgggtcttggaagaccctaatagagaactcaggcttcatcctctaagagatggagatccagttaggagattttgaacagggtttgtgttttagataggtcgttactggctggattatgaagaattaatttaaggyagacagactggaggtcaggtgagtcgttgggaggcattgcagtagttcaggcaaggagggtaataggcggggacccagagcataaatttggagaataggaggattgttcttagataaaggactcttcttcctctgaagttggaggtttgtgggcatttgtagagagtgagacagaacaggaagtagaaatcattcatggctgatagctttggttttttcaattaccaaccaggagcattggtggagtgagggtaagacagctgggactgagtagaggttttaggtgagtagtgtagggtgggagctaagggcatgagagat

SEQ ID NO: 562 - DNA, 562 bp, Homo Sapiens
  allele 501: 12-77-478 : polymorphic base A or G
  misc_binding 481..500: 12-77-478.mis1, potential
  misc_binding 502..520: 12-77-478.mis2, complement
  primer_bind 28..46: upstream amplification primer
  primer_bind 512..532: downstream amplification primer, complement
  misc_binding 489..513: 12-77-478 potential probe
attccagcagagggagctccataagcatagggacgctgtgtgaaagagtagatgtgtgagataatgcaagggaagagtagtgagtgagaggctggagaggaaagagtgggtcttggaagaccctaatagagaactcaggcttcatcctctaagagatggagatccagttaggagattttgaacagggtttgtgttttagataggtcgttactggctggattatgaagaattaatttaaggcagacagactggaggtcaggtgagtcgttgggaggcattgcagtagttcaggcaaggagggtaataggcggggacccagagcataaatttggagaataggaggattgttcttagataaaggactcttcttcctctgaagttggaggtttgtgggcatttgtagagagtgagacagaacaggaagtagaaatcattcatggctgatagctttggttttttcaattaccaaccaggagcattggtggagtgagggtaagacarctgggactgagtagaggttttaggtgagtagtgtagggtgggagctaagggcatgagagat

SEQ ID NO: 563 - DNA, 1001 bp, Homo Sapiens
  allele 501: 12-80-114 : polymorphic base T or C
  misc_binding 481..500: 12-80-114.mis1, potential
  misc_binding 502..521: 12-80-114.mis2, potential complement
  primer_bind 595..614: upstream amplification primer, complement
  primer_bind 101..121: downstream amplification primer
  misc_binding 489..513: 12-80-114 potential probe
ttttctctcctggatggcagtttgtgatctccccactgcacatgttcttaatcttccttcagaagcacagaagaccccagctcaggaatgtaagccagctgattttgaagtccctgaaacctttttgaatcgccttcaggacctgagctcctcctttctgaaggacattgcaggtaaggagggaagtaggaggatggtctcgtatctacttgtctggaggtcatcttaccaccaagcaaggcccttacctcaggttattcctcttcttttcaaacctggtctggtttgacgttcagagcactttgtatagtccctttgtgtccatagtgccctgtatcttgttgcctaaagtttgaggttacgcaggttgtctggattttgagaaagccgctttatttctgccctctctccacagtgtttatcactgataagatctccagcttctgtcttcaagtggctttacaggttttacaccgcaaacttccccagttttgcgctcayctctgcaatgctgtgattggctacctgagtactcgcggttcctcagtagatggcaggtatggtcagggcctcaggatcgacccaagttggcggggctgtgtgaaatgaatgaggtgatgtagtgcaactgtattttgcatgaaatggagttaagactgcctgatgcccttcttgtccctagtcccctactgctatttctccgagatcagacgagttccagactcctggagcaggtcctgctggtgttggagcccccaagactccagagcctctttgaggagcacttgcaggggcagctgcagaccctggctgcacatcccattgccaacttccctttgcagcgcttactggatgcagtcactacccctgagctggtgagttggaaacctgagctggatctgtttctgctaattcttgatcactggaccttattttatggtctgtctgcctctatatacctttgacattgtgctggccattgcccttgaaaagctattctt

SEQ ID NO: 564 - DNA, 1001 bp, Homo Sapiens
  allele 501: 12-80-233 : polymorphic base G or A
  misc_binding 502..520: 12-80-233.mis1, complement
  misc_binding 481..500: 12-80-233.mis2, potential
  primer_bind 714..733: upstream amplification primer, complement
  primer_bind 220..240: downstream amplification primer
  misc_binding 489..513: 12-80-233 potential probe
aagtttcttagaaaaattaagacagaaatgtagtctcagttcagtcatccagaagagacatttagttgtactacatctgttctgcatctccaagcggaatccttgttcatctgtgaaatttttctctcctggatggcagtttgtgatctccccactgcacatgttcttaatcttccttcagaagcacagaagaccccagctcaggaatgtaagccagctgattttgaagtccctgaaacctttttgaatcgccttcaggacctgagctcctcctttctgaaggacattgcaggtaaggagggaagtaggaggatggtctcgtatctacttgtctggaggtcatcttaccaccaagcaaggcccttacctcaggttattcctcttcttttcaaacctggtctggtttgacgttcagagcactttgtatagtccctttgtgtccatagtgccctgtatcttgttgcctaaagtttgaggttacgcaggttgtctggattttgrgaaagccgctttatttctgccctctctccacagtgtttatcactgataagatctccagcttctgtcttcaagtggctttacaggttttacaccgcaaacttccccagttttgcgctcacctctgcaatgctgtgattggctacctgagtactcgcggttcctcagtagatggcaggtatggtcagggcctcaggatcgacccaagttggcggggctgtgtgaaatgaatgaggtgatgtagtgcaactgtattttgcatgaaatggagttaagactgcctgatgcccttcttgtccctagtcccctactgctatttctccgagatcagacgagttccagactcctggagcaggtcctgctggtgttggagcccccaagactccagagcctctttgaggagcacttgcaggggcagctgcagaccctggctgcacatcccattgccaacttccctttgcagcgcttactggatgcagtcactacccctgagctggtgagtt

SEQ ID NO: 565 - DNA, 454 bp, Homo Sapiens
  allele 250: 12-82-250 : polymorphic base A or T
  misc_binding 230..249: 12-82-250.mis1, potential
  misc_binding 251..270: 12-82-250.mis2, potential complement
  primer_bind 1..21: upstream amplification primer
  primer_bind 436..454: downstream amplification primer, complement
  misc_binding 238..262: 12-82-250 potential probe
ctgacaataaatgtgtgctggattgagctgaatctttattacatctctgctcagtcatttttaatttcttcttttctcaccacagccaatcagttgccaatagattctagcccccaaacgtctcttctctcagttactcctttcttttccactgcctttgtatgacttcaggtcctcataatctctagcaaggctgttgtaaaaattaacgagataatgtatggcacttcttaatgaagtgctaggaaawaaatctaaagtattatttttgctgataccttttttagacgttaaaagggtttactgatgatttgtgccacctgtttccaacacaaaattcgaaacattctatcgtaatcacccctccctacctgagctcctgtttcccaccacagcctatgataaccaggactgcccagttagtgggcgctctgaccacatttgttccatactc

SEQ ID NO: 566 - DNA, 423 bp, Homo Sapiens
  allele 85: 10-176-85 : polymorphic base C or T
  misc_binding 66..84: 10-176-85.mis1
  misc_binding 86..105: 10-176-85.mis2, potential complement
  primer_bind 1..18: upstream amplification primer
  primer_bind 404..423: downstream amplification primer, complement
  misc_binding 73..97: 10-176-85 potential probe
ctttccthtccacctggccctgcgtgggctctgtcctcagggtggcccgccgtagtccccctccccactctgagtttcctgtccyaaagtcctaaggaagtttccagaactacatctcaccatcttgagtcagccttggctcagtgtccatctcacaggcctggaaggggcaggagtcagcactgtccagaccacagggcctgagtgtggggagggcagccgtctaggaaggtggtggagggttgttaccttgaggcaagagggctgcggggcagaaagacacagcaggtgactgttgtgggaggcccaagagaggcctgggagagggatggcccacaagggctgaccctcccgccacccagggggccttggacaggtttcctcctggcagggtggcccttgtgcatggaacccctacaacga

SEQ ID NO: 567 - DNA, 423 bp, Homo Sapiens
  allele 51: 10-176-51 : polymorphic base C or T
  misc_binding 31..50: 10-176-51.mis1, potential
  misc_binding 52..71: 10-176-51.mis2, potential complement
  primer_bind 1..18: upstream amplification primer
  primer_bind 404..423: downstream amplification primer, complement
  misc_binding 39..63: 10-176-51 potential probe
ctttccthtccacctggccctgcgtgggctctgtcctcagggtggcccgcygtagtccccctccccactctgagtttcctgtcccaaagtcctaaggaagtttccagaactacatctcaccatcttgagtcagccttggctcagtgtccatctcacaggcctggaaggggcaggagtcagcactgtccagaccacagggcctgagtgtggggagggcagccgtctaggaaggtggtggagggttgttaccttgaggcaagagggctgcggggcagaaagacacagcaggtgactgttgtgggaggcccaagagaggcctgggagagggatggcccacaagggctgaccctcccgccacccagggggccttggacaggtttcctcctggcagggtggcccttgtgcatggaacccctacaacga

SEQ ID NO: 568 - DNA, 423 bp, Homo Sapiens
  allele 207: 10-176-207 : polymorphic base G or T
  misc_binding 187..206: 10-176-207.mis1, potential
  misc_binding 208..227: 10-176-207.mis2, potential complement
  primer_bind 1..18: upstream amplification primer
  primer_bind 404..423: downstream amplification primer, complement
  misc_binding 195..219: 10-176-207 potential probe
ctttccthtccacctggccctgcgtgggctctgtcctcagggtggcccgccgtagtccccctccccactctgagtttcctgtcccaaagtcctaaggaagtttccagaactacatctcaccatcttgagtcagccttggctcagtgtccatctcacaggcctggaaggggcaggagtcagcactgtccagaccacagggcctgagtktggggagggcagccgtctaggaaggtggtggagggttgttaccttgaggcaagagggctgcggggcagaaagacacagcaggtgactgttgtgggaggcccaagagaggcctgggagagggatggcccacaagggctgaccctcccgccacccagggggccttggacaggtttcctcctggcagggtggcccttgtgcatggaacccctacaacga

SEQ ID NO: 569 - DNA, 423 bp, Homo Sapiens
  allele 397: 10-176-397 : polymorphic base A or C
  misc_binding 378..396: 10-176-397.mis1
  misc_binding 398..416: 10-176-397.mis2, complement
  primer_bind 1..18: upstream amplification primer
  primer_bind 404..423: downstream amplification primer, complement
  misc_binding 385..409: 10-176-397 potential probe
ctttccthtccacctggccctgcgtgggctctgtcctcagggtggcccgccgtagtccccctccccactctgagtttcctgtcccaaagtcctaaggaagtttccagaactacatctcaccatcttgagtcagccttggctcagtgtccatctcacaggcctggaaggggcaggagtcagcactgtccagaccacagggcctgagtgtggggagggcagccgtctaggaaggtggtggagggttgttaccttgaggcaagagggctgcggggcagaaagacacagcaggtgactgttgtgggaggcccaagagaggcctgggagagggatggcccacaagggctgaccctcccgccacccagggggccttggacaggtttcctcctggcagggtggmccttgtgcatggaacccctacaacga

SEQ ID NO: 570 - DNA, 419 bp, Homo Sapiens
  allele 219: 10-177-219 : polymorphic base A or C
  misc_binding 200..218: 10-177-219.mis1
  misc_binding 220..239: 10-177-219.mis2, potential complement
  primer_bind 1..18: upstream amplification primer
  primer_bind 400..419: downstream amplification primer, complement
  misc_binding 207..231: 10-177-219 potential probe
ccttggacagggtttctcctggcagggtggcccttgtgcatggaacccctacaacgactaaggctggcaggcatgaggtttcctgaaggagaaagagcttgtggggcccagtgtggctgggggggcgctgggactccattctgaagccaaaggcactgggaagggcttccgcagaggagggtttggcaggggttgccaggaacagcctggatggggacmgggaacagataaggtgggtggaggagttagccgggagcctggggctggctccagcatgatgtgggggtctgcaaggccctggagaaagtggggtggtgcagcagggggcacacccacagctggagctgacccagatggacagcttggctctgccacgcgggactaggcaaggaagggcacgaacaagcaggaagtggtga

SEQ ID NO: 571 - DNA, 448 bp, Homo Sapiens
  allele 85: 12-214-85 : deletion  CCTAT
  misc_binding 65..84: 12-214-85.mis1, potential
  primer_bind 1..20: upstream amplification primer
  primer_bind 429..448: downstream amplification primer, complement
aatggtgaggaaggtatggggagtacctggccctacttttctgcccatggcccactgggcagagcctcagcctctccaccctatcctatttctccccaatcagcctccactgaagggacctgctgccctgtcaactgggtggagcaccaagacagctgctactggttctctcactctgggatgtcctgggccgaggctgagaagtactgccagctgaagaacgcccacctggtggtcatcaactccagggaggagcaggtgagggcttctggtactcagttcctaagacatgtcccatttagggaaatggttcttaagcttggccgcacattggaatcatctgggagcttccagaatgactgtcatctgtgccacaccctcagagatttaataggcctgagcatccagagaaacatctccaaactcctcagttgatttaacgaagagc

SEQ ID NO: 572 - DNA, 499 bp, Homo Sapiens
  allele 271: 12-215-272 : deletion  T
  misc_binding 251..270: 12-215-272.mis1, potential
  primer_bind 1..20: upstream amplification primer
  primer_bind 479..499: downstream amplification primer, complement
  misc_feature 87: n=a, g, c or t
gttgattgttttctttgctgtgtagaaactttttagtttgatataattctatttatttttgctgttgttgcttgtgcttttggtacnatatccaaaaatggatatggattttgatggaccccccaaattattgtcaaaaccaatgtcatagagctttcctgtatgttttcttctaacatttttatgatttcaggtcttacatttaagtctttaatccattttgagttgacttttgtgtatgttataaataaggtctaatttcattttttttaatgtttatgttcagctcttttgtttttgctcacaatttctttagatattagaagtcttttgtagctcaatacaagttttaggatttcttttttctatttcagtgaaaaatgccattggaattttgaaaggggttgcagcgaatctttagatcactttgggtagtagagacattttgataatattgatttttcctattcatggacatgggattttgtgaaataggttt

SEQ ID NO: 573 - DNA, 407 bp, Homo Sapiens
  allele 163: 12-221-163 :  variant  GTCCTCA or T
  misc_binding 143..162: 12-221-163.mis1, potential
  primer_bind 1..21: upstream amplification primer
  primer_bind 387..407: downstream amplification primer, complement
gatgaactgagactaggaatggagtaattctgttccagaagctcacaaggaacagaatgagatgagactgccttggacgtctgtagaaaaactgtttagatggcagttgcaaaaaaactgaaaggaattgttcccatacatcagcaaaactgttgagctacagtcctcattgggttctgtccctctatcagagggacatgagtgaataggaagtgacctcatttgccattatgctcccctgccctctgaccactcacattaatccagaaatctttaccagttcacaacatccaatcagagccaatactgaggtagaggcaggtctctacttctcgacgtaaggaactggaatcacccctctcttgcctttgctgtcctctgtgttccacgactgctcttcaggcttt

SEQ ID NO: 574 - DNA, 598 bp, Homo Sapiens
  allele 82: 12-225-82 : deletion  T
  misc_binding 62..81: 12-225-82.mis1, potential
  primer_bind 1..19: upstream amplification primer
  primer_bind 581..598: downstream amplification primer, complement
catttccagccttatcttcatctcagcccagccatgccctaatcccaatactaaccccagcttctacattttctttttttttgagactgagtctcactgtgtcgtccaggctggagtgcaacggcacaacctcggctcactgccacctctgcctcctgggttcaagtgattctcctgcctcagcctcccaagtagctgggattacaggcgcacaccaccacacccagctaatttttgtatttttagtagagatggggtttcaccatgttggccaggccggtctcaaactcctgacctaaagtgatctgtctgcttcggtctcccaaagtgctgggatttataggcgtgagccaccgcacctgtcgccccccacccagctcctacttcaaccccaaccccagaatcaacttgaattttaacaccagcccaaagccaaaattgaacctcgactctattctgtttccaaattcaccaccaaagttaaccccaattccatccatggctccaacgtgcatactgaccccaatcctagcatgagatacaacctccagtcctgcctgattaactggcccactgggtagtcctagcaatgcgttta

SEQ ID NO: 575 - DNA, 1001 bp, Homo Sapiens
  allele 214: 10-234-179 : deletion  AA
  misc_binding 195..213: 10-234-179.mis1
  primer_bind 36..56: upstream amplification primer
  primer_bind 346..366: downstream amplification primer, complement
  misc_feature 888: n=a, g, c or t
catttccaaagatccatgggaaattttatttttgtgctttacattttactctgtagattacgttaatggatgccaattatgtcatggatgaaactctagggacagcaacatttactgtatcttctatgaaggtgggagaaaagaaagaagttccttttattttcaaccaagtaagtaacactgcagaattatattccaaccttatgttagataaagtctattgattctgggaagttgggtttaacacttggaaaattgtatttatttgttcatagaatgtttgctttttaaagagaaaattttgtttttctttttactttttgtcctaattttaaaaattattctgacatctataaactttggttgaggtattataccaaacactactaaggctttaatctcctttgttgctccaaatgatgacattgggattcagcaatgcctttggactctaatggcaaaatttaatacaaaaaattggggaggataaaaagacatgcaaaatctgagagctgggggcagagagagagagagagagaacaagtaaacaaactcagtggaaaatgttaggaaattcagactattccaaaaccacatgtttagtaataaatctctctgggggaatatttctgtctcagagaatcctcaagtaaatagggacaaagcagtgaaaggccaaaaggattgatgggaggttattgttatctttgactttctaggtttgctacatttctgaaattttgatagtttattttggaataatgaaaccttaggtaaataattttgtacagaataaactcattggattttgaattctgtaagaaactaatttagtagtttgtagtaagaaatgtaaacaactggtgggcctgtatgtgtaaggctggntaccatactaatttcttgttgttgggagagacaatgtgtctctgcgcatctttagaatgactttccaagtccctacattcacctcaacctacctctcccttaactctcagctt

SEQ ID NO: 576 - DNA, 1002 bp, Homo Sapiens
  allele 491: 10-235-272 : deletion  T
  misc_binding 471..490: 10-235-272.mis1, potential
  primer_bind 220..237: upstream amplification primer
  primer_bind 553..571: downstream amplification primer, complement
  misc_feature 178,181,388: n=a, g, c or t
ctgaggcagctcctaaataatagacacaacatctcagtagtttttatatctcaggcactttttatattttgtaaatagtagttgtggtgagctactttattttactgagggaggaaaacaaccaggcagagataattcttgtgtttgctaaaatgacgtactaagtagacttacaaanaanaataccaaaaagttggtttactgaaatacgcctgtagtttagggtcttcatggagctgtgttacttttatttttagggttttgtttttttgattaaaaataatctggcactcaaaatttattttgagtttgtttccatgatataaacacatatctactttatgacctaatctgattaacatgtctttttttaggtcactgaaatggnttctagaaatgtctcttgaagtttggtaagtgcatttatttagttggatgagaaatattgtgagtgatccactaatttattttaattgttaaagaatttttttatatataattctgcagctgtgaacatatagaagtgcattatgtttactttgcttttctttagttgtctgttaatacctacaaaatctttacaaacatattcttatattcattattcttatattttaatatgctttgcttatttttccaatagtttcatggtcatataataatgtcagaataagtgctttatgaaagagtcctccctctagtcgtacatctattcccatagaaatgaatgcagttatttaagcgcctcttctattgttgattcaggtagatattcaaaaacatagaagtgaacttaaacagaaactatataataatttttaaaattgagactgattttattcatactgacccagctggactactgctaataatgttccatgaagcatactgctctttcaaaatggcctccaaaactgaacgttagggaatcatgtacttattttcaaacggcgaattttagggtaggcaagtctgccttgatctaactgttctctgatgtaa

SEQ ID NO: 577 - DNA, 1002 bp, Homo Sapiens
  allele 498: 10-251-342 :  variant  GG or C
  misc_binding 478..497: 10-251-342.mis1, potential
  primer_bind 157..176: upstream amplification primer
  primer_bind 515..534: downstream amplification primer, complement
ctcatgagcaagaactcattcccagtgacggcattaatctcttcatgagagatcagccccaggacccaaatacctccctctaggccccacctttaacactggggatcaaatttcaacatgaggtttggaggggaagaacatctaaaaccatcgcaagtaaaatcttgtatctgagctccttctagaaatgagtaatagaatacctttttctcaaaaaatattatttatctgagtttaagataattaagtaaatcatgcaattacatgctagagaagagcttacaatagaatgggatttctttcagggtgaccgatctgaggactttggtgtgaatgaagacttggctgattcagatgccagggtaaggaagtgcttacaaaatactgctgcagttcatcttcctaccttaagtggggctaccacatgatcccctgtgaaagcaaatctaagatcttctgagagaccaatggcttcttaatgttcatttcctgaatgaggcatgtctttctgtagcccccacacacaaaaaagtagtctttgtaagttttcaatatctctcattattcgtaaaaccagagagaactgaagaaggacaatacaaatttgatttgtcattcccaagaattgtttgttaaaaaaaactctgacctttcgttgtactaggtataagaaggggaaatgtaatttttttattatgtgcaatggaaagagtaagcatatttaacgttatttttaacagagaactttggaatggtttatagatgtcaatttatattgtcaaaatattactgcaatgatataacaagagtataggataaattataataatatatgctttctaacatattgttttatttagtttcagtgacattgctgattatttatatgccaaaccactggcaacataagaaaaatcatatcattttaaagcctggaatttccatttaaaacaaacaaacaactaatatttgcattatgccttctcatggaacagtattctc

SEQ ID NO: 578 - DNA, 1002 bp, Homo Sapiens
  allele 497: 10-395-367 : deletion  A
  misc_binding 477..496: 10-395-367.mis1, potential
  primer_bind 140..159: upstream amplification primer
  primer_bind 531..550: downstream amplification primer, complement
gttgcattagccatggggaacattttgtttttgcattcacacatcagtctccccaggttctgtttacacagaggaagagaaagactggctagtttagtagtccatcccaacccaaggcagaccatctctgaggtttagtttttacagtcgtaagatgggaattgcatctgtttgcaaaaactactccaatatcgtcagatgaaatggtccaaggagtagaaattagcataatgaatcgctgtgcttcagagtaaaggagagcctcttcataaagactttttgttgtactttttttccagcttccttcaaaatgtctactgttcacgaaatcctgtgcaagctcagcttggagggtgatgtaagtatatcactttcactttatataatttttgcaagttggacatctctctggataaccatattactctctatccttgtacatctaaggaagatggggacaattcagacagtcatcatttggttctcctctttcttaatacttcagctgttcctagtagttcaatttgaaggaaatatcatggcactggaaacttttcttggcctcacattaaaattggacagaattagtgacactggaatggctggaattttattctgccatacttagcatgtcattggtaataactgttatgatggtacatgacttttaatgtcatgtcctgggattttattactggttggcataagccacagccatatcaaaactaattctgcatcttttggatttcttacagtgtccaggaagttattccagatgaagacttatacttttattttatttattaatttattcattttttgagatggagtctcactctgttgccaggctggagtgcagtggcgtgatctcggctcactgcaacctccacctcctgggttcaagcaattctcctgcctcagcctccccagtagctgggactacaggtgtgcaccactacacccagctaatttttgtatttttagttgagactgggtttcacc

SEQ ID NO: 579 - DNA, 1002 bp, Homo Sapiens
  allele 498: 12-730-58 : deletion  ACAA
  misc_binding 478..497: 12-730-58.mis1, potential
  primer_bind 441..459: upstream amplification primer
  primer_bind 948..968: downstream amplification primer, complement
gattcaattacctacacctggtctctcccttgacacgtggggattatgggggttgtgggtattacaactcaagatgtgatttgggtgtggacacaaagcctaaccatatcaatggtcaaataagaatggaaaaaatattgggtttaattacattcaatagactcctttctttcaaggcagggattctcagaagtaatacatatgtcagcctacttttcattgacatgaatataaaatcctcatttcacagaacacctgtgaatatattgaataacattagtattcaacagaacaggatcaggaaacttcctctagaaggcgctttccaaataaagaccaaatacactgctgcaggagggaagaataaattcatttacatatatgtctgtggtaagggataaaatcttaaatttttgctggcttcacttatatgaaataattcagtgatttgggattttgtgttagttagctcttgttgcaataagtctacataacaaacaatttccatatctcagacatttataacattaacttctcattcacaggtctgaatcctggctgggacagtttggctttaagtagtacatcaaattcaggtgtgttccatgtgtttttcattcaggaatccaggcaaaaaagctgtggctacctcagtgtgcttttctcgtggtgtagaacaggtgcacaaaattgctggcaaacatttaccaaacctcttaagcctcagcctagaactgatcacctatcactttaccacattccattggtcaaagaaagtcatatggccacacccaaaactagtggggcagggtggtatattctacccacagagaagacaggcaagggcagggagagaaggaagaatggtaagtaactaataatattcactacattgaccataaattcaagatttaaccatgtgtgggaattcaatcatatttttatttcctttaaacacaaatgtcctggtcaataattcaaacgtgcacattattagactta

SEQ ID NO: 580 - DNA, 1002 bp, Homo Sapiens
  allele 459: 12-735-208 : deletion  AACGATATGTTATATGGCACTTACACTACTTGTGAAAGTATTTACTAGTAGAATGAG
  misc_binding 459..477: 12-735-208.mis1, complement
  primer_bind 647..665: upstream amplification primer, complement
  primer_bind 133..153: downstream amplification primer
  misc_feature 835,839,842: n=a, g, c or t
cctgttataatcctgttgtactcatttttggggtgccatttcaaacatgcaagttttacttaagttcttacactcatatttagatttaaaaaattattcatttattggttttagtaggtaaaatagtcaggtggttcaaatatcaaagagcactaaagtgcatagtctgaaaagcctccctgccatccatatacccatctacacagttcccatccttctccaacgaacaaccactattgttagtttctggtttatccttccagagactttaaatatatatatacaagcacagtatatgatttccttcctctattttatccaaaatattatgctattattcaccttccttttattacctaacagtgaaacatatcttagagatcttttaaaatcctaatataaacgatatgttatatggcacttacactacttgtgaaagtatttactagtagaatgagaacgacattctcattcttttttacagttgcatagtattgttttgtaggaagttatcataagtattaagcagtcccctatggatagatgtccaagttttccaatcttctgacaaacaactctgcaataagttatctattacataaattatacaaatgcataggtatatctataaggtaaattgctagatgttgaagtgctgcataaaagggaatatttttaattgtcattccattgccaaattgccctccagaggattttcaccaatttatactcccacaagcaatttatgaaagtgatcatttctctacatccttgcccaggacgtgttagcaaacttttagcctttgcctaagtggttaaaaaaaaaaaaaaaaanaaanaanaaggattactacagtgcagttttaatttacctgtctcttctattatgtgcaaggtggagcatctttgcatgtatttaagttttatctgtggctccttttggtaaactttctaataagtattttgttattgacatttaggatctctttatattctaaagaa

SEQ ID NO: 581 - DNA, 1002 bp, Homo Sapiens
  allele 498: 12-739-22 : insertion G
  misc_binding 498..516: 12-739-22.mis2, complement
  primer_bind 476..494: upstream amplification primer
  primer_bind 907..927: downstream amplification primer, complement
acccacagcaaaaggcaattgccagttttaatattttggcatattctattgctgcctcttcctattcactacttttttttttttttgagatggggtcttactctgtcgtccaggctggagtgcagtggcgcgatctcggctcactgcaagctccacctcccgggttcacgccattctcctgcctcagcctcccagggtagctgggactacaggcgcccgctaccatgcccagctaattttttgtatttttagtagagatggggtttcactgtgttagccagaatggtcttgatctcttgacctcgtgatctgcctgccttggcctcccaaagtgctgggattacaggcgtgagccactgtgcccagcccctattcactactttaaaaaaaaaaccatattaacagttgaactccaacatgccagttccaccatcttgtgctctggtgaagcattttttaaaggaatagaaaatgccattactttgtgctaaggggtagagtatagattcttcagaaggaatgtagaaagcaggatgctaacagacccaatccatgtttgcaatttacttgatggagatcagagaagtaggctaatggtggggaagcatttccctgctgatgttcgtgcttcctggttcacaggggctgggaaccgacgaggactctctcattgagatcatctgctccagaaccaaccaggagctgcaggaaattaacagagtctacaaggaaagtgagtagcttgatttctgtgattcatcctctcagcccaatttatgtgactctatcatggccactggggttagggttcgggctaagatgcctgcattagtgatgtgcagaagtgcctgccaccttgactatgcaggcaaggttggctgtggtccaagtttctctccttcacctcctcattgcctgcattttgattattacattccactagaacttctgtgttagaagaagggtagacaggagggaaaggagagaaaacaaaacttgttt

SEQ ID NO: 582 - DNA, 1001 bp, Homo Sapiens
  allele 498: 12-540-363 : insertion T
  misc_binding 478..497: 12-540-363.mis1, potential
  primer_bind 939..957: upstream amplification primer, complement
  primer_bind 425..445: downstream amplification primer
gaagcagcagccaagcagagtgtttgctctgagtgctgagggtctaaaactgggaatggagtccatgctgattagaccccctaagctgtggatcattatgcaccatgcacatcctgatcctgggtagcagcaccctctctcaagcccctacaaggctggagcactacctctgtgggggagcttacactcagcgatgtcccctggggacacctggcttagaccacattccagtgtccctgccagcagctggagtctttggtccaaccttcgctatggccctacccacaatagccacccttgaacaggcacaaatattagcctgggtctttctgcagctatcttgggaaggtttctgcctctgactttacaaatggcctttgaatgaatgaatgaatgaatgaacatcaatcagtcaactagattcattcactaaaatctctctctctctctttttaatcagagtttttgtttttgcactaaacttttacagaaagagagctgagatgcatgcataagttgaaatcaggaacttactcaaaaaggcaattctcagactgtgcctgggacttagcacaaattgcatcaactgctcacactcaattctatttgaatcagtcctgacacatcacaatagtttcaatcatcagaggaagattcaataacattaaccatgttgtagctactaaggcagaaaaatagactcacacattttctaaagattgtcagtaacaaggttgagacataaagagggctttcagttcaccctcagcaaaccagaaaattaaattaaccagtggctctccgttccccagtggtctgggtaattgaggcttattgtattagaaaacatttaaactatttgtagtttgatagaaaagaaaaatccatcactgaaaacttcagtttgcagtttgaaatagtacaagatttctttatttctaccacctaacacatattattaagtaatctcattacatttttgctattgaagaacaggatct

SEQ ID NO: 583 - DNA, 1002 bp, Homo Sapiens
  allele 497: 12-550-206 : deletion  T
  misc_binding 477..496: 12-550-206.mis1, potential
  primer_bind 292..310: upstream amplification primer
  primer_bind 788..807: downstream amplification primer, complement
cttaaagttgacaggttgtttctacaagtggaggaacaacatgagcatgcactgtcatgatgattgatttctagtccacaagtatacagtcttcaaattaagtataatttggcctgaaatcacattgtccattagtaaaatattccattgtattcatttgaggagctttctctcctccatgggtcaaaacaagcatcccaggattatgttcatccccaaaaataggatagaggtgtgagtttgcttaattggctacttgctgctccctgacacaggtccctgtcctcttccatgtggactatgtgccctgggtaggctcagcggtcctctctactgatcacaggctgactgtgcctccacctgcagcagcgtgccatagaattctcttccattggtctcgctttagccttaacttggaaagaacccttccttacttccctccctgcctggaagatcccacagtgctggccttttctgaaaaaagatgctcatcttttgttttttaattgcttcatagttcacctttttataaaagggaaagcaaagaggcattaaacagcgtgactcactgggaaagctagtatttcagccagacagaagagttcattggaggatgggaagttcagaggaatatggctggggggatgaacacctgattagaagggtttgtagggtattagaataagtttgtatttatctaggcattgaggaaaccggggtcattcaaggctttacacagaacagtagcaaaattagattttcctttgaaaaggaaactctgatgctggtagggagagtggttgaaggggagcaaggctggaagcagtgataccagttaggagaccatggcagtagttcaagaaagagatgttgtgaacctagtgccttaatcctctgctgaatctgagagtctcctctccattggcctgtgactaggaccataggccaatctcctactataaaagataaaaaggctgatacaaacatttctaggcttgcttg

SEQ ID NO: 584 - DNA, 463 bp, Homo Sapiens
  allele 409: 10-207-410 : insertion C
  misc_binding 389..408: 10-207-410.mis1, potential
  primer_bind 1..18: upstream amplification primer
  primer_bind 443..463: downstream amplification primer, complement
  misc_feature 14: n=a, g, c or t
gtaggacattttgnttggctcttaatgacatttgtaggtcaactgtgtagatttgtatgcatttctaaagtatgtttttcccccaatgtgaaatttagtagtaaacttaataaatttccattccaactctcaagtctgtaatttgactcagaaactatactaaattttttgctaggatggcaatggctatattagtgctgcagaacttcgccatgtgatgacaaaccttggagagaagttaacagatgaagaagttgatgaaatgatcagggaagcagatattgatggtgatggtcaagtaaactatgaaggtaaatgtttcagtctcacgcctcattcttcactttgatttttaagataagaggctctttgttagggaactgatcgaaattagtgacccttcccccgaaattaggttgctaaaacagttacttacatttaaccttcttaaaattcagagtgt

SEQ ID NO: 585 - DNA, 351 bp, Homo Sapiens
  allele 255: 10-171-254 : deletion  GG
  misc_binding 235..254: 10-171-254.mis1, potential
  primer_bind 1..19: upstream amplification primer
  primer_bind 333..351: downstream amplification primer, complement
ttgcttytctaacggcgacgccgtttcccccttcgcctcgttactcctcaaagccccacgcggccacagagttcagacttacccaccaccaccttgcagtggctcgccccagtttgacgcattgcagggaaggtcggaccaatgggcgccaagctctcatttccgccatgggccaggcccaatagtgacgcggctcacagagggacgcgtcacgcaccgccgagctgtgcccctccgccgaagaaagtgaagtgggcccgggaggcggggcgcgcggcgagggaaagtagtccggcgacgggagcgagcgcgcgcgcgcccggcggcaaacccaattcctgtgcagggtgg

SEQ ID NO: 586 - DNA, 1102 bp, Homo Sapiens
  allele 498: 12-94-110 : deletion  AATT
  misc_binding 479..497: 12-94-110.mis1
  primer_bind 389..409: upstream amplification primer
  primer_bind 916..936: downstream amplification primer, complement
  misc_feature 842: n=a, g, c or t
tggcagcgcagataaaataagcaaatgatataataagcaaattgcaatgggaaggggagaaggaaaaagatatatatatatatctttacactcaccagactgtggaggattcaccaccagactgggaaacaacagcctgggctccagagttggacactcaccaccagactgggaagtaacagcctgggctccagagtccaccactcatccgtgcacagatgaggagcggcctcatgaagcttcggtgcggtctgggaccctatctctttttgtaacgagttgtttggcatgaggtccagtcaggagggcccttcgcaactgggctcaaggaacacaaaaaggtcaacctgtttttgtgattgtctgttgtttttcaataactaatgtacaggaatagattgaaatagagatttttctgaaacagcgctggatgaatgcctcaaggggctcaaacaacctgttccaggacttggtgactattgtttgtgttcatgtttaattgagttcaaatttaatatttaacttttcctccacaatgggtgagtttgtattactatgttttactgtctcatgaataaaatcctaaaataaaagccacaaaatctttgtgtttaggtgtgcctacacatatgtacatttattattttctgtgttgtatctatatggtaaaacctgatgtagtcagtagaattcccttaagaaattctattcagattggctagataagtgaatgctcatataaattgttaaaatatatagtaactaacccaaatgcattttagttcatgtgacttaaataaatctttgataaatatgctagttttaattctgttgataaaatnaaaaatagaaatgtcttcagaattgtcagcatatatttttgactgagtttaccgattagacagttttatatttgtctctgctaaatgttttaaggggtcaggatttgacacaaagtttataaaactgtatatctagtctaaaaataaaatgatctttgtgtaactttaataagtaagacaaatttaataatgttaatttaataaaacagctattatcagcaaaatttttgttatcttgttctcagcaaaatacccatatg

SEQ ID NO: 587 - DNA, 1002 bp, Homo Sapiens
  allele 498: 12-834-290 : deletion  G
  misc_binding 478..497: 12-834-290.mis1, potential
  primer_bind 207..227: upstream amplification primer
  primer_bind 638..658: downstream amplification primer, complement
  misc_feature 309,378: n=a, g, c or t
ctggaactacaggcgcctgccaccatgcccagctaattttttgtatttttagtagagacggggcctcaccgtgttagccagaatggtctcgatctcctgaccttgtgatttgcccgcctcggccttccaaagtgctgggattacaggcgtgagccaccgcgcccggcctggaatatttacttttttgattggacacatcaatattaactctgggaaaaacttccatctcactctgggaaaaagtgcaatataaggttatcgatagtcacaaggaaaagcatgcaaaagagaacaggatagttcaaaacntggctttggtagaaagaaatccataataaaaaaggaaaacattccaaccattttattttttctcagtcnaacaaatgaacagtgtaaaacaaaccatagctttgcggctgaagcattatatcagcaagtttacaaagaggaatttattacgggagtattaatgaaggaggggagttgattagttaaaggaagtgactctagattgactccaggaatgacttccaaacccatgctacagaactgggccgccaaggagctgctggctcaggaagctgcctgctgaatgaggagccatagccacagctggctgctccaggaccatggcacagtctgcacaagcaaacgcacatccccatcaccctccctctttccacatacggctgggctctcatatccaagtctcagtgaggtgcatctgactggcagagccttaaccacaacaaattcctaaccgcaagggactctgggaaataaagttctaacattttccaacctttgcacattagcagctgattctaccacagtgacaattcctaatcctacgtgaagtcttccaacctggaagttaaagaaattgtggctctaaggaaaggaggctctggaagatgacgtctgtaatagagacaagaaaaaaaaactggcccatcacagtaaggcaatccatgagaatttgtgtcagtccagattcacccc

SEQ ID NO: 588 - DNA, 418 bp, Homo Sapiens; identical to SEQ ID NO: 329
  allele 114: 10-55-115 : deletion  TTATA
  misc_binding 95..113: 10-55-115.mis1
  primer_bind 1..19: upstream amplification primer
  primer_bind 401..418: downstream amplification primer, complement

SEQ ID NO: 589 - DNA, 1002 bp, Homo Sapiens
  allele 498: 12-857-122 : insertion CTCT
  misc_binding 478..497: 12-857-122.mis1, potential
  primer_bind 376..395: upstream amplification primer
  primer_bind 889..909: downstream amplification primer, complement
aacctgggaggcagaggttgcagtgagctgagattgtgccactgcactccagcctgggcgacagtgcgagactctatcaaacacacacacacacacacacacacacacacacacaagaaatattatcccaaattagtcatgtatacgttgcatcctaccatatttaattaaggaatgctattttatctattctctctccataagtcacttctcaaatgacatacagagaaataaatgagtaacgtcataggttatacatgcaggtaaaatagggaagtagtgagtgctctctaatacttcagtagtaatattgccttttctttctttgctcaatttagtgtttaatttttgtggttggctttcttgttcttttttatggtagcaacacgcaagcctttattggttttgaagtttaccctgctaaaattcttcctgtaaatacaggaacttccctctctattacagttcctgtaaatacaggaactgttaacttccctattatcagaagatcaagatcctgagacatttatttgttccttccatcatcatagcattaccagtgtatcagagtaatagtcatagaacagaacaaatgtactttttctcctttgtatttccttttaccaacttcatctgtattccatggaagtcattcctttgccttaaggtggcttcagattcctagtaaagaatgtgaaggtaaatagaatgaatattcgggcttcagatacaggagactttcgagactacaataagattatagacttaaataaaaagctttgtcaaaagaaggatgttctaaatgctttaggagcccaataatataacaaggacagaaatggtctaattgttaagatttcagtaagccacggatatttataaaccaatggagggtggaagaatatgcttcccctacccccaatatacctctttgatataaggatttttttcatataaaggcacttgataaacagcagaagcaaaaggacattctaatcttct

SEQ ID NO: 590 - DNA, 1000 bp, Homo Sapiens
  allele 498: 12-872-175 : deletion  T
  misc_binding 478..497: 12-872-175.mis1, potential
  primer_bind 324..344: upstream amplification primer
  primer_bind 767..785: downstream amplification primer, complement
tatgtgcaggtcacaggggatataatggcttagcttgggctcagaggcctgacagagatcatcctggctaacacggtgaaaccccgtctctactaaaaatacaaaaaattagccgggcgtggtggtgggcgcctgtagtcccagctactctggaggctgaggcaggagaatggcgtgaacccgggaggtggagcttgcagtgagctgagatcaggccactgcactccagcctgggggacagaacgaggctccgactcaaaaaaaaaaaaatccatgaaaaataaacagtttgtgtttgttgttcttccattcccgtacagtgagtgtaaaaggtacatattaggaaatcttgaaaatgtttttagtaaacaactagcatagtaatttatctatatggcaactgattaatccatgtcttccccaatatgtctggtggttgttaatgattatatgaatttatttcaatcaaaataaagcttatgctgacctactttttttaaggacttgatatgttggtctggacacctgagaatatatttccgtcatgtagaaaaacaaccacaatttttatccatagtgtaaaataatagaagtagaatgaatgatcaaaggcccagggaaacagtttaaatcaattagaactctgtcaaaggctgctttgagaaacaatagacatgtgattggacagtgtaatgaaagacattcaggcctcagaatccatgccaactttatcctgtttgaacatagttttatacaaactagtaatcctagtaatctgaagtagtaataatagtgagaaagaagaaggaaatagtaaacatcgaagtttcagtaatcaaataaaatcaactgaatgaaaagtagacttttactaagatataaaaactcccccaaacatgcataatagatctgaatacacaagaatatttgtattaacataacactttatgaatttaatatggcttatggaaaaggatgtttaccaatagtctaagctaca

SEQ ID NO: 591 - DNA, 1002 bp, Homo Sapiens
  allele 498: 12-882-40 : deletion  A
  misc_binding 478..497: 12-882-40.mis1, potential
  primer_bind 459..478: upstream amplification primer
  primer_bind 904..924: downstream amplification primer, complement
aaggaggaaaagtgaaaaatgtcatttctacacagccaaagcattagaccctgtcttgtagattcatcctttgaactctttcatttgaaaaattacccagttcttaacctgataatggatgagaaaaataatcccttgcctttctccaccaaagacctaaagataaatattgcttttctaaaaaattaaaaataaatcttaaaaaatctcaaattttctatctggcttcatcttgttcatgtcgaaaacacaacagtggggtgtcagcaaagctgtaatacctgagaataaaagcgtagtgccaatacgcatgaacagaaattctgttcagacatgctgaagccttctgcagaaactaacagaatccaactggcttcattaatttcagccatctacatctttttcttcttatataaacaattaatgttttggttttcctttctaaagaaaatcatgtggagattttattcattctccctaagcctacttactgtcaaattgacacatggcttaagtgaatagaacctccaatttccttttttgttcaagagctactgttaggtaggagaagtatatctgaatccttgcaaaaaaaagaaaacttcaaaaggaaatttttaagagaaaaagaaggtaagtacatgtgtaacctccgtttcagacgcattacctattgtatcgttttctttgcagtattgtaaagcatgaaaaaaataggaattaagatgtcaaaaaagaattttccttttttaaaagtctgagctggaagggataggaattcttaaatccaaaaggaaaagtaaggtttgaaatatcaatttgatcacacaggtttttttttttctttttttttttggtagtgatttgaacaaaaacaggaaaagtgcctacacatggatataagtggcaaaacagtcaactatcaaaaggatagctgtaagcagtgattaataaaatttagttatagacattactaaagaccagatgtccagctaactgaca

SEQ ID NO: 592 - DNA, 1002 bp, Homo Sapiens
  allele 498: 12-888-234 : deletion  C
  misc_binding 478..497: 12-888-234.mis1, potential
  primer_bind 711..731: upstream amplification primer, complement
  primer_bind 281..301: downstream amplification primer
tagagaaaaaaaagcaatgccacctaatatgtaacctctgctcccaatttaatgatctacatttgtaatcacaagttaccacatcatgcattacactgtagggcgtaatccaggtacaaagttagctttgtatagtaattaacttcctttatttacagtttagaaatatttacttctgatccaacttgtttataatttaaggtcaattcaagtttatttctttaagaagcattcttcaatggtttactgggaaactcagaaaatagggaacagggaagctggggactcacagaacaaagacatgaacatggctcaggaactaagttttcagtgcaactagacaagtatctgacatagaatggaggctcaatggatatttgtcaaataaataaaaatattctgctggaaaaaacacaggtacacacactacatttcctactactggttataactcagtgtttccatcacatgagagaagtccttaacagccacactttcgattcagaacagcccctaattacacctgaaagttaccagctgaaaggcccagaactgtctctacagtcacttagatcatcccaagacttttgcagtttgcgaggtcatctgcataaaaatgtatttttgaaaaaggttcataacaactgccaggatattgtttcttacagcaggaatcatggaaaaatatccagtcttctatatcaaggaagcttcttgctggtgagatttagcaatgggtatattgatttcatctcaaggtaattagtgtcactttttggatccctaaaccttagacaaaaaataaatttattcactggctaagtaatttttcaagagagtgattaatgaagaaattatgcaaaacacttgaccagtattcctcaaacctgtccaggacataaaaaacaaggaaagtcttacatgttgtcacagctaagaggagcctaaatgtgacaactaaatgtattaccttggatgggatcttggaacagaagaaggaca

SEQ ID NO: 593 - DNA, 1001 bp, Homo Sapiens
  allele 499: 12-278-353 : insertion A
  misc_binding 479..498: 12-278-353.mis1, potential
  primer_bind 147..166: upstream amplification primer
  primer_bind 657..677: downstream amplification primer, complement
gtgtcatccagagtcatgcaggttgtaagtaatatggctgggacaggaaataccaccgcagggccctttaccccctccaggctcttctgattccaaagtcactgttaaagaaattcagatacttctggaacttcccaagaggcgaagttctccaacaactatactctgaagtgaaatatagcagtgtgtttcctttcccccaatgtatcagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaaggtacagccagctaccgccccacctgctatgggagggcatctgagatgtggagtgggagggatcactgacatcccacagggggacctgtggctgggagtgggtggcagaaagggagccctggagagatgttctcagagtcagtaatgcccctaaaggaagaaaacagctaggagcctgctgttccccaggacacgcggctggggcatgggcctgacacacgggcctcgctggccagccagtagagttggaaaaggcaaatgagttcatggtgatcctcggctgatgctgatggccgcccctgccatcactctccgtccctgttctcgaatcctacaagcattggctgctggggtgactgcatgctaaaagtacccatgtgcctcagtttcctcaccagtaaaacaggtcaaatagtacagctgccttacagaatgatggtcagattaagacagtgaactcagggagcaaagaggtaagcattgtacaagtgctggccaggaccctctgaatcattatcatgcttagtaagcatcagaggggtgcaggcctccagcacttattcagcagaaagatcagcacccagcct

SEQ ID NO: 594 - DNA, 1002 bp, Homo Sapiens
  allele 498: 12-283-386 : insertion T
  misc_binding 478..497: 12-283-386.mis1, potential
  primer_bind 114..132: upstream amplification primer
  primer_bind 547..567: downstream amplification primer, complement
cagttatcaaggcacctttgccatagtggggtgccagctacattgggtgggatgcccaggggctgtccctacctaagcactttcttgtctacaggaagtcttggtgcttttcaagttcagcataaggggttccatatgtgaagtggggattcacacttagaaaatctatcctggtcttcacctgaaacactcatctactgctgggtggcaggaacaagtatacaaaaccaggggccttgcctgggcagttcctaagggacattggcagggctgacctgggattcagctcccctgagtggacagtctgtggttgcctggggtccccaggctgagaaggggtatgggtaattgcacttcggggcacagtgaacacaggcacgggctggatgtgccctgggagacagaaaggagaggctgacctattctcaggagctggctatggctggacagtgcctgcccggccagaggaaggccacagcagagccactccacagactaagacctgtgttgccaaggaatcagacactggcttggaggagacaggaggacaaagcctgctgctattaagcccacaccgtagcttagagatccttcagcctcctggccttcaaaacaaactccagggcttccactctgaaaggcaaaggaatcacctcgtgtttgcttcatccccttagcaggatgaacgaaacgcctaaggcccaaaaagactgagggcaggacccccagcatctcccatctcctccgtgcaggctgggtgagagaatggcctggaaaggaagcatctgcgctacattgtgcttcaggcccccccagcaactttcccggaggtaactatttgcctggaaaactaggaaactgggttttaaaaacagaattttaagcagactttttagagggacaaggccatttgatggtagtgattttggttttgttttatgaaaatggtacaggtggtaatccctgatgacagaatgcactgagagtggggccaagggccct

SEQ ID NO: 595 - DNA, 1002 bp, Homo Sapiens
  allele 458: 12-44-181 : deletion  C
  misc_binding 438..457: 12-44-181.mis1, potential
  primer_bind 618..638: upstream amplification primer, complement
  primer_bind 235..254: downstream amplification primer
agacttgcacactaaaatccaacttcttgcaagggtagaacagaaatgcaaagaggttaatgactcccttgtaatcaagaagccatgtagtggcaggatatgagggaactcaactctggagctttcttcttggataggaaaattctaatgtggaaaccagatttgcagtgattggaggtattgtcccttctcacaggtaaggacaagccttctaggtcagtggagactcagaactctttgaggggaaggagagggaggagaagcagtgctgaggcagtcacaaacagcaaaacacattcttgagtttccatgttatggacgcaagtggcacgtgaataggatctgccaatgagtggagagcaatttcaatgagcagtctattgtatatacagggctgtgctgaacagactagtagtgattccaacacctatttttactcctaccttggtctgccatactatatagccctaaaatcccagatagtagcactccaaccttaaacccacctgtactttatgggggagtctaaggcacctctgagaattccccagcgtgaactatcagccagaagttggtctgtggatggcactgccatacccgactgacattatttaacagttggaaaaaatgctgctgtcaggaatctgattttatttcagaaaaatgaagcctcttttttggtaactttttgggaatttcttagaaaatggcacgtgttcattgataaggggcagtggagtgtagactgggtgactggcaaaatgaaaagactcagttgcctatgacttctcttcccctgggaaaccttgttaatgctttggtgcaccacctccttctggaacattttatattacttttccaatgtttccaaacattttccaatagctgtgaatggctaaacttggtcaaatgaatgtcctttaatttcatatttagataatttctaactatttttcctataataaacaatgaactgtaaaacaaaaacaaaaacaaaaaaaa

SEQ ID NO: 596 - DNA, 1001 bp, Homo Sapiens
  allele 501: 10-370-132 : polymorphic base C or T
  misc_binding 481..500: 10-370-132.mis1, potential
  misc_binding 502..521: 10-370-132.mis2, potential complement
  primer_bind 371..389: upstream amplification primer
  primer_bind 772..791: downstream amplification primer, complement
  misc_binding 489..513: 10-370-132 potential probe
  misc_feature 47: n=a, g, c or t
aaggagccaggatatagggattcaaatcctgcttttgtcacttattntcgataagatttgaggcaagtttcctaacctgtctttctcattttacttatctgttaaatgggggatacgtatagtacctattgcagagagcttttaaaagggttaaagtagttaatacacattaagccttttgaatagcaagtgttcgataaatattattaaaactaaaatttgaagtttttatagaaatcaatattatgtaagtgatgcaatcttattttattaaaccaaaattgaaatttaactgcagtatatcaggaagaatctaaatattacttacagtgaagaagatgctggtcagaacataattacactcaggtatgaatgaatgatggaattgcaggtatgttttactaaatggtatagctcatgagtctcacacccaggtgaattccctagtgctataggatttgattcatttatggtctcccattatttatactgtatttgttyttcattgattttattctttgcagtcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaatttctttgtttgctttcagagcttgccaacattgtttgatgcctggtgccaacaactaatattttaaaacatgtttctgta

SEQ ID NO: 597 - DNA, 1001 bp, Homo Sapiens
  allele 501: 10-370-254 : polymorphic base C or T
  misc_binding 481..500: 10-370-254.mis1, potential
  misc_binding 502..521: 10-370-254.mis2, potential complement
  primer_bind 249..267: upstream amplification primer
  primer_bind 650..669: downstream amplification primer, complement
  misc_binding 489..513: 10-370-254 potential probe
tacctattgcagagagcttttaaaagggttaaagtagttaatacacattaagccttttgaatagcaagtgttcgataaatattattaaaactaaaatttgaagtttttatagaaatcaatattatgtaagtgatgcaatcttattttattaaaccaaaattgaaatttaactgcagtatatcaggaagaatctaaatattacttacagtgaagaagatgctggtcagaacataattacactcaggtatgaatgaatgatggaattgcaggtatgttttactaaatggtatagctcatgagtctcacacccaggtgaattccctagtgctataggatttgattcatttatggtctcccattatttatactgtatttgtttttcattgattttattctttgcagtcggatacttctggagactatgaaatcacactcttaaaaatctgtggtggagatgactgaaccaagaagataatctccaaaggtccacgatgggctttyccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaatttctttgtttgctttcagagcttgccaacattgtttgatgcctggtgccaacaactaatattttaaaacatgtttctgtatagaagctgttactgcttcagtttatcaccttgttaatcacacttttttgaaagaaaggaataagatgaagatgtatgtgaccctggcctaccctttgtagttgtgatcaagctataggagt

SEQ ID NO: 598 - DNA, 1001 bp, Homo Sapiens
  allele 501: 10-485-256 : polymorphic base A or G
  misc_binding 481..500: 10-485-256.mis1, potential
  misc_binding 502..521: 10-485-256.mis2, potential complement
  primer_bind 246..264: upstream amplification primer
  primer_bind 652..669: downstream amplification primer, complement
  misc_binding 489..513: 10-485-256 potential probe
atggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgrtatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttctccttacttttgctctctataaatttagcatactgaagagatctgagaatgcaaattttgaaaaaaattcaaggtatttcacatactaaacatcatcagatggtttttcttaaattagaatttcaaaagggaaatttactggtgcataggaaaaggtgattggatccagggtcacagttgctgccataaggtctc

SEQ ID NO: 599 - DNA, 1001 bp, Homo Sapiens
  allele 501: 10-485-257 : polymorphic base C or T
  misc_binding 481..500: 10-485-257.mis1, potential
  misc_binding 502..521: 10-485-257.mis2, potential complement
  primer_bind 245..263: upstream amplification primer
  primer_bind 651..668: downstream amplification primer, complement
  misc_binding 489..513: 10-485-257 potential probe
tggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgayatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttctccttacttttgctctctataaatttagcatactgaagagatctgagaatgcaaattttgaaaaaaattcaaggtatttcacatactaaacatcatcagatggtttttcttaaattagaatttcaaaagggaaatttactggtgcataggaaaaggtgattggatccagggtcacagttgctgccataaggtctcc

SEQ ID NO: 600 - DNA, 1001 bp, Homo Sapiens
  allele 501: 10-474-320 : deletion of A
  misc_binding 481..500: 10-474-320.mis1, potential
  primer_bind 182..199: upstream amplification primer
  primer_bind 590..609: downstream amplification primer, complement
aactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtaagcccggcgcccagccgcggaaatttctctgcccacacactccgagactcgccccgccgcccgaggtgcactggcggagacaagggaggccgcgcccggcgtgcccactttgccacttccaaaatttgctgaagctgaggctgtgagcacacctcagaagtggctgggagggaacccaaacctaattgccaaatttcaggtccaggaggggagcctcttgtgtgtttattgtttgtccgtctatttcgtgactgcgcaggcccgcgattcctctcctcttgtctataggtagcgctggtggattggaatcttgaagcaggtgtacagtgtaaagctgccctggatgagcaatttgaacctcagaagactctgttcatccagtgcgatgtggctgaccagcaacaactgagaggtaagacaggggaatcaatctgtcaactgggaacgtgctctcaacaagcaacaacctgaaggcagcccggccagggggccctgggtgccgcctccgctgcctcctcgagagcagctaccttgaagctccaaaagacagtttggactgatacgtttccttctgacagcccaa

SEQ ID NO: 601 - DNA, 1001 bp, Homo Sapiens
  allele 501: 10-387-371 : polymorphic base C or T
  misc_binding 481..500: 10-387-371.mis1, potential
  misc_binding 502..521: 10-387-371.mis2, potential complement
  primer_bind 131..149: upstream amplification primer
  primer_bind 535..552: downstream amplification primer, complement
  misc_binding 489..513: 10-387-371 potential probe
aatgaacacatgtgtgaatggaattcaaggcactgcaggctattctggagggtactggcctgtctcttcgacaggtgaggtgcagtagaacagcatcccgtatagatgccagtttctgacctggttctgaaaagccagtcacctacctctgcagagctgcctggagggggcgggggttgtgaggacccctgagagcttggtgtgaaggggctctgcagagggaggcatggctagtgtgcgcaaggtgacctctctcctggtctgcaggatggagaacctgttcatcaaccgcttcatgcacatgttccagtcttcttggaatgacttcgccgactttgagaaaatctttgtcaagatcagcaacactatttctggtgagtgtgcctctgggggcccaagtggtgctggggacaggggatgctgctctcctgtctgatacttgccgggaaattgacaagggccttcctgcctgctgcagcatgggggcctcgctgccaccaygccaccctggacagcaccccctacactccacaccttttaccatcactgtggtcacccttgtgcccagaggtttctcctcctcagatattcaagctcgagcaccctcaacctcatttcactatcaaaagtctcaaaagtatcagaactttttcttggcacaaatcaatcatttgtgcttctgaacagagcaaaggcagaacttggcttgtgttttaggtatttacacaaaagcaactttgggttcctttggactaggatgtgtttgatgagagcactagcttcatagtggccagtcatggcatgggaaggacgttaggaaggcaggaatggctggacaagaagaggtgctgaaatcaggacatggggaaccaaacttggcaaactgcccccagggactctcctccacgccctccttcttccatcctggacactccatgctgggctgaaggacctgagtgctccaggaggcttctgagccacgaagggccagctcaggtatg

SEQ ID NO: 602 - DNA, 1001 bp, Homo Sapiens
  allele 501: 12-570-239 : polymorphic base T or C
  misc_binding 481..500: 12-570-239.mis1, potential
  misc_binding 502..521: 12-570-239.mis2, potential complement
  primer_bind 719..738: upstream amplification primer, complement
  primer_bind 255..274: downstream amplification primer
  misc_binding 489..513: 12-570-239 potential probe
ttaactcaagttgtggcattaattatggcttgcattaaatgcatcggtaatatgcttctgcggtggatttttccaccttagatttcagggaatggaagtgatgggagcgggtagggaaggtctgaggttactaaacagatggagcctcctggatctgcaaacctcatatgattctaggcctctgagcctctggcgcagcaataattctgcagccgagcccactagccgcttcccagtgaccatgcgcaacaggcaggtgggagcctatggaaagcgcggactttcggaaagctgcacgagcgcgttcggggagtccggttcagcgcctctgcgcaggcgcagtggtccccgcaggcttgcgcgcgcactcgctgcgggacaagcttctggaagctctttgcggtggcgttggtgctgtttgcggatgctgatgcaggtactggtcgtcccgggccccgagtttcggggccgtggccgggtcgccggctccgagggcgcacytggggcgggatgggggccgggagcagcctaccaacgggctgtgcgctgcgctgctgctgcttctgtgggaggtgcgcactccgctgcgggatggggctgttggcttccctccatccctccctgcgccacttgggcactgttgacattttgggcgggataatgccttgttttgtttgtgtggtgtggcggtgagggggaggctctcccgttgttgcaggatgtttaacagcgtcactggttctgcccgttagataacagtaccacctctcgtcccagtcgagctaaccaaaaatgtgtccagacattgccagaggaccgctggggggtgaaatctctccttttttcttccctctggttgagatcctctggctgcgtcacattttcaccgggcctcctatgtaaactccctgtagacggagccgagtgtcttagtcatcgcggagccccaggtgctcagcacggcgccaggtacgtggtgggcgcctaatatttggcagagg

SEQ ID NO: 603 - DNA, 1001 bp, Homo Sapiens
  allele 501: 12-570-344 : polymorphic base T or C
  misc_binding 481..500: 12-570-344.mis1, potential
  misc_binding 502..521: 12-570-344.mis2, potential complement
  primer_bind 824..843: upstream amplification primer, complement
  primer_bind 360..379: downstream amplification primer
  misc_binding 489..513: 12-570-344 potential probe
agagaagtaaggtataatcaagaagctattgcaataatccaggtgagccatgagggtggactggaccatgggggcaggtgtggaagtcataagattaatatgtgtttaactcaagttgtggcattaattatggcttgcattaaatgcatcggtaatatgcttctgcggtggatttttccaccttagatttcagggaatggaagtgatgggagcgggtagggaaggtctgaggttactaaacagatggagcctcctggatctgcaaacctcatatgattctaggcctctgagcctctggcgcagcaataattctgcagccgagcccactagccgcttcccagtgaccatgcgcaacaggcaggtgggagcctatggaaagcgcggactttcggaaagctgcacgagcgcgttcggggagtccggttcagcgcctctgcgcaggcgcagtggtccccgcaggcttgcgcgcgcactcgctgcgggacaagcttctggaagctytttgcggtggcgttggtgctgtttgcggatgctgatgcaggtactggtcgtcccgggccccgagtttcggggccgtggccgggtcgccggctccgagggcgcacctggggcgggatgggggccgggagcagcctaccaacgggctgtgcgctgcgctgctgctgcttctgtgggaggtgcgcactccgctgcgggatggggctgttggcttccctccatccctccctgcgccacttgggcactgttgacattttgggcgggataatgccttgttttgtttgtgtggtgtggcggtgagggggaggctctcccgttgttgcaggatgtttaacagcgtcactggttctgcccgttagataacagtaccacctctcgtcccagtcgagctaaccaaaaatgtgtccagacattgccagaggaccgctggggggtgaaatctctccttttttcttccctctggttgagatcctctggctgcgtcacattttcaccgggcctcc

SEQ ID NO: 604 - DNA, 985 bp, Homo Sapiens
  allele 501: 12-570-393 : polymorphic base T or C
  misc_binding 481..500: 12-570-393.mis1, potential
  misc_binding 502..521: 12-570-393.mis2, potential complement
  primer_bind 873..892: upstream amplification primer, complement
  primer_bind 409..428: downstream amplification primer
  misc_binding 489..513: 12-570-393 potential probe
tcataatttgacgtttttaaaacgtccgtctggctgtggagaatagccaagagaagtaaggtataatcaagaagctattgcaataatccaggtgagccatgagggtggactggaccatgggggcaggtgtggaagtcataagattaatatgtgtttaactcaagttgtggcattaattatggcttgcattaaatgcatcggtaatatgcttctgcggtggatttttccaccttagatttcagggaatggaagtgatgggagcgggtagggaaggtctgaggttactaaacagatggagcctcctggatctgcaaacctcatatgattctaggcctctgagcctctggcgcagcaataattctgcagccgagcccactagccgcttcccagtgaccatgcgcaacaggcaggtgggagcctatggaaagcgcggactttcggaaagctgcacgagcgcgttcggggagtccggttcagcgcctctgcgcaggcgcagtggtycccgcaggcttgcgcgcgcactcgctgcgggacaagcttctggaagctctttgcggtggcgttggtgctgtttgcggatgctgatgcaggtactggtcgtcccgggccccgagtttcggggccgtggccgggtcgccggctccgagggcgcacctggggcgggatgggggccgggagcagcctaccaacgggctgtgcgctgcgctgctgctgcttctgtgggaggtgcgcactccgctgcgggatggggctgttggcttccctccatccctccctgcgccacttgggcactgttgacattttgggcgggataatgccttgttttgtttgtgtggtgtggcggtgagggggaggctctcccgttgttgcaggatgtttaacagcgtcactggttctgcccgttagataacagtaccacctctcgtcccagtcgagctaaccaaaaatgtgtccagacattgccagaggaccgctggggggtgaa

SEQ ID NO: 605 - DNA, 1001 bp, Homo Sapiens
  allele 501: 12-570-421 : polymorphic base T or G
  misc_binding 481..500: 12-570-421.mis1, potential
  misc_binding 502..521: 12-570-421.mis2, potential complement
  primer_bind 901..920: upstream amplification primer, complement
  primer_bind 437..456: downstream amplification primer
  misc_binding 489..513: 12-570-421 potential probe
ccattgcagggttttaagcaaaggagggtcataatttgacgtttttaaaacgtccgtctggctgtggagaatagccaagagaagtaaggtataatcaagaagctattgcaataatccaggtgagccatgagggtggactggaccatgggggcaggtgtggaagtcataagattaatatgtgtttaactcaagttgtggcattaattatggcttgcattaaatgcatcggtaatatgcttctgcggtggatttttccaccttagatttcagggaatggaagtgatgggagcgggtagggaaggtctgaggttactaaacagatggagcctcctggatctgcaaacctcatatgattctaggcctctgagcctctggcgcagcaataattctgcagccgagcccactagccgcttcccagtgaccatgcgcaacaggcaggtgggagcctatggaaagcgcggactttcggaaagctgcacgagcgcgttcggggagtccggktcagcgcctctgcgcaggcgcagtggtccccgcaggcttgcgcgcgcactcgctgcgggacaagcttctggaagctctttgcggtggcgttggtgctgtttgcggatgctgatgcaggtactggtcgtcccgggccccgagtttcggggccgtggccgggtcgccggctccgagggcgcacctggggcgggatgggggccgggagcagcctaccaacgggctgtgcgctgcgctgctgctgcttctgtgggaggtgcgcactccgctgcgggatggggctgttggcttccctccatccctccctgcgccacttgggcactgttgacattttgggcgggataatgccttgttttgtttgtgtggtgtggcggtgagggggaggctctcccgttgttgcaggatgtttaacagcgtcactggttctgcccgttagataacagtaccacctctcgtcccagtcgagctaaccaaaaatgtgtccagacattgccagaggaccg

SEQ ID NO: 606 - DNA, 1001 bp, Homo Sapiens
  allele 502: 12-570-62 : deletion of TG
  misc_binding 503..522: 12-570-62.mis1, potential complement
  primer_bind 543..562: upstream amplification primer, complement
  primer_bind 79..98: downstream amplification primer
ggcctctgagcctctggcgcagcaataattctgcagccgagcccactagccgcttcccagtgaccatgcgcaacaggcaggtgggagcctatggaaagcgcggactttcggaaagctgcacgagcgcgttcggggagtccggttcagcgcctctgcgcaggcgcagtggtccccgcaggcttgcgcgcgcactcgctgcgggacaagcttctggaagctctttgcggtggcgttggtgctgtttgcggatgctgatgcaggtactggtcgtcccgggccccgagtttcggggccgtggccgggtcgccggctccgagggcgcacctggggcgggatgggggccgggagcagcctaccaacgggctgtgcgctgcgctgctgctgcttctgtgggaggtgcgcactccgctgcgggatggggctgttggcttccctccatccctccctgcgccacttgggcactgttgacattttgggcgggataatgccttgttttgtttgtgtggtgtggcggtgagggggaggctctcccgttgttgcaggatgtttaacagcgtcactggttctgcccgttagataacagtaccacctctcgtcccagtcgagctaaccaaaaatgtgtccagacattgccagaggaccgctggggggtgaaatctctccttttttcttccctctggttgagatcctctggctgcgtcacattttcaccgggcctcctatgtaaactccctgtagacggagccgagtgtcttagtcatcgcggagccccaggtgctcagcacggcgccaggtacgtggtgggcgcctaatatttggcagaggaataaatgacgtcatgctgctgtgtgccgggcgctgtactcggaagtgggttgttattggtatggtagttgcaatgcgaggctgtcacatccttcacttgtcgcattgtagtcccgctccggctgtattgtcatttcctggaccctctgtgagcgtgaggaccctttcaggcctgt

SEQ ID NO: 607 - DNA, 444 bp, Homo Sapiens
  allele 141: 10-4-144 : polymorphic base A or C
  misc_binding 121..140: 10-4-144.mis1, potential
  misc_binding 142..161: 10-4-144.mis2, potential complement
  primer_bind 1..18: upstream amplification primer
  primer_bind 427..444: downstream amplification primer, complement
  misc_binding 129..153: 10-4-144 potential probe
  misc_feature 53: n=a, g, c or t
cattaaggagagcctgaggstgcatccccagtccctgccgtcttcgctgctgncccaagacattgtgctcccagacggccgggtcatccccaaaggtgccacagcctcagggggaggagcctcctgggtaggaagaggggmccctcaggcagggagcmttgtcctgactgcccccttctctcccacaggcattatctgcctcatcagtgtttttggaacccatcacaacccagccgtgtggccggaccctgaggtgcgggccccccvtctctgtttttgtccattccaaggctcctagaggagggggcagggttttgatcaggagaatccaacatcrcctccctccaagacacacaccactgtctbtccaaggctggcggactgggagaccccacccggcaacccttcttggtctckyctccaggtctatgacccctttcgctt

SEQ ID NO: 608 - DNA, 444 bp, Homo Sapiens
  allele 158: 10-4-161 : polymorphic base A or C
  misc_binding 138..157: 10-4-161.mis1, potential
  misc_binding 159..178: 10-4-161.mis2, potential complement
  primer_bind 1..18: upstream amplification primer
  primer_bind 427..444: downstream amplification primer, complement
  misc_binding 146..170: 10-4-161 potential probe
  misc_feature 53: n=a, g, c or t
cattaaggagagcctgaggstgcatccccagtccctgccgtcttcgctgctgncccaagacattgtgctcccagacggccgggtcatccccaaaggtgccacagcctcagggggaggagcctcctgggtaggaagaggggcccctcaggcagggagcmttgtcctgactgcccccttctctcccacaggcattatctgcctcatcagtgtttttggaacccatcacaacccagccgtgtggccggaccctgaggtgcgggccccccvtctctgtttttgtccattccaaggctcctagaggagggggcagggttttgatcaggagaatccaacatcrcctccctccaagacacacaccactgtctbtccaaggctggcggactgggagaccccacccggcaacccttcttggtctckyctccaggtctatgacccctttcgctt

SEQ ID NO: 609 - DNA, 444 bp, Homo Sapiens; identical to SEQ ID NO: 608
  allele 267: 10-4-270 : polymorphic base G or C
  misc_binding 247..266: 10-4-270.mis1, potential
  misc_binding 268..287: 10-4-270.mis2, potential complement
  primer_bind 1..18: upstream amplification primer
  primer_bind 427..444: downstream amplification primer, complement
  misc_binding 255..279: 10-4-270 potential probe
  misc_feature 53: n=a, g, c or t

SEQ ID NO: 610 - DNA, 444 bp, Homo Sapiens; identical to SEQ ID NO: 608
  allele 337: 10-4-340 : polymorphic base A or G
  misc_binding 317..336: 10-4-340.mis1, potential
  misc_binding 338..357: 10-4-340.mis2, potential complement
  primer_bind 1..18: upstream amplification primer
  primer_bind 427..444: downstream amplification primer, complement
  misc_binding 325..349: 10-4-340 potential probe
  misc_feature 53: n=a, g, c or t

SEQ ID NO: 611 - DNA, 444 bp, Homo Sapiens; identical to SEQ ID NO: 608
  allele 366: 10-4-369 : polymorphic base C or T
  misc_binding 346..365: 10-4-369.mis1, potential
  misc_binding 367..386: 10-4-369.mis2, potential complement
  primer_bind 1..18: upstream amplification primer
  primer_bind 427..444: downstream amplification primer, complement
  misc_binding 354..378: 10-4-369 potential probe
  misc_feature 53: n=a, g, c or t

SEQ ID NO: 612 - DNA, 444 bp, Homo Sapiens; identical to SEQ ID NO: 608
  allele 417: 10-4-420 : polymorphic base G or T
  misc_binding 397..416: 10-4-420.mis1, potential
  misc_binding 418..437: 10-4-420.mis2, potential complement
  primer_bind 1..18: upstream amplification primer
  primer_bind 427..444: downstream amplification primer, complement
  misc_binding 405..429: 10-4-420 potential probe
  misc_feature 53: n=a, g, c or t

SEQ ID NO: 613 - DNA, 420 bp, Homo Sapiens
  allele 396: 10-13-396 : deletion of AAT
  misc_binding 374..395: 10-13-396.mis1, potential
  primer_bind 1..19: upstream amplification primer
  primer_bind 402..420: downstream amplification primer, complement
ctgggtaagtaactgtaggtggacgggacggggacaacttttgtggccaggggaagattctgcccttgcccacagcctttggctgccgtactaggggatgggctcttgttaagtgttggtgacaagtggagacaccaccgtcgcttgctgacgcctgccttccatttcaacatcctgaagccctatataaagattttcagcaagagtgcaaacatcatgcatgtgagtgccttgaactcagcatcccagctgcagccttggggtggagggatcacatacaattgggtctggaatgttggctctcctgggtgggtttggggccattgctcttcctctctgtgccttgatttccccatgaggctaataatcctcactaaaaggtggtaggagcatgtaatggactcatgtctctgacactta

SEQ ID NO: 614 - DNA, 1001 bp, Homo Sapiens
  allele 501: 10-509-284 : polymorphic base C or T
  misc_binding 481..500: 10-509-284.mis1, potential
  misc_binding 502..521: 10-509-284.mis2, potential complement
  primer_bind 218..235: upstream amplification primer
  primer_bind 618..637: downstream amplification primer, complement
  misc_binding 489..513: 10-509-284 potential probe
cctgtgatgtgctcacattctggtttaatgcttattcaataataaaactgttttctttcttcactactttcgtggagaggttttttctgggttgggagaaaattttgcttctaattatattctcccaacatagcgcatgtgcttaaaagggaaacaaaagcaggagggggaagggtctagagtgataagagctctagtgagaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagayaaactcttttctaggcaaaagtaacccacgaaaatgtgtgtggaaaggccagatcctactattaggcaggatgggaatttgagccattttatttggatattacagaatggggtgaccccagaaaactggaagaactggggaccagcaaatggccgacctgcagtcctgagcagaggatgtaggccagagtggacctagaagataagaaagggaattgaatccagtaagggacagacactttatttttttatttttatttatttatttatttatttttgagatagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagcaggcttcatct

SEQ ID NO: 615 - DNA, 1001 bp, Homo Sapiens
  allele 501: 10-509-295 : deletion of C
  misc_binding 481..500: 10-509-295.mis1, potential
  primer_bind 207..224: upstream amplification primer
  primer_bind 607..626: downstream amplification primer, complement
ctcacattctggtttaatgcttattcaataataaaactgttttctttcttcactactttcgtggagaggttttttctgggttgggagaaaattttgcttctaattatattctcccaacatagcgcatgtgcttaaaagggaaacaaaagcaggagggggaagggtctagagtgataagagctctagtgagaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagacaaactcttttctaggcaaaagtaacccacgaaaatgtgtgtggaaaggccagatcctactattaggcaggatgggaatttgagccattttatttggatattacagaatggggtgaccccagaaaactggaagaactggggaccagcaaatggccgacctgcagtcctgagcagaggatgtaggccagagtggacctagaagataagaaagggaattgaatccagtaagggacagacactttatttttttatttttatttatttatttatttatttttgagatagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagcaggcttcatctgactgattcct

SEQ ID NO: 616 - DNA, 1001 bp, Homo Sapiens
  allele 501: 10-339-124 : polymorphic base C or T
  misc_binding 481..500: 10-339-124.mis1, potential
  misc_binding 502..521: 10-339-124.mis2, potential complement
  primer_bind 379..396: upstream amplification primer
  primer_bind 776..795: downstream amplification primer, complement
  misc_binding 489..513: 10-339-124 potential probe
ttagtagagacggggtttcaccgtgttagccaggatggtctcgatctcctgacctcgtgatccgcccatcttggcctccccaagtgctgggactacaggcgtgagccaccgcgcccggccgcatccctcaattcttaaccactttttgaggcaagggatatttggtcactcagaacttttcagcccccaatccttccataacaataattattacttacttattgagcatttattacagaccaggtgattttgatacatcatctcatttataatgtaggtatcgtccatattttacaggtgaaaaaaactgaggttcaaataggttaagctggcctatggtaactaagtgtaagtgactgagccaggacttaaacgcatgtctgatgcaaatacgtctaaataaaataaacaaattcatcaattctaaaatatgggcatcccaaaacaacagcctttgttcctctcctcttatgctgtagcttctaactgctattcctttcytgcccaggtttccctgtctccttccagtcccagagtcaactctgccatttcctcaccatgtgcgtcttcacgtgcactgcccagcatgccgccatcaaccagggccaggtatggacagctgaaagcccaggtcatgaaggcaaggtgacctgagggagagatgggagttcaaaccctaagtaccagggttctagggttacagtttcttcctccagctggactggtatgcctgggtccctaatgctccatgcacaatgcggatgcccccacccaccaacaaggaagatgtgacgatggccacagtgatggggtcactacctgatgtccggcaggcctgtcttcaaatggccatctcatggcatctgagtcgccgccagccagacatggtgagaggggactctcgggagagggaaatgacagttggaaaggaaacatcagagtgaggggctgggctctaggtgcgtttgtctttagaaactgactgatcctttgttctgtct

SEQ ID NO: 617 - DNA, 1001 bp, Homo Sapiens
  allele 501: 10-340-112 : polymorphic base A or C
  misc_binding 481..500: 10-340-112.mis1, potential
  misc_binding 502..521: 10-340-112.mis2, potential complement
  primer_bind 390..408: upstream amplification primer
  primer_bind 791..809: downstream amplification primer, complement
  misc_binding 489..513: 10-340-112 potential probe
gtatcgtccatattttacaggtgaaaaaaactgaggttcaaataggttaagctggcctatggtaactaagtgtaagtgactgagccaggacttaaacgcatgtctgatgcaaatacgtctaaataaaataaacaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccaggtatggacagctgaaagcccaggtcatgaaggcaaggtgacctgagggagagatgggagttcaaaccctaagtaccagggttctagggttacagtttcttcctccagctggactggtatgcctgggtccctaatgctccatgcacaatgcggatgcccccacccaccamcaaggaagatgtgacgatggccacagtgatggggtcactacctgatgtccggcaggcctgtcttcaaatggccatctcatggcatctgagtcgccgccagccagacatggtgagaggggactctcgggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgcta

SEQ ID NO: 618 - DNA, 1001 bp, Homo Sapiens
  allele 501: 10-340-130 : polymorphic base A or T
  misc_binding 481..500: 10-340-130.mis1, potential
  misc_binding 502..521: 10-340-130.mis2, potential complement
  primer_bind 372..390: upstream amplification primer
  primer_bind 773..791: downstream amplification primer, complement
  misc_binding 489..513: 10-340-130 potential probe
aggtgaaaaaaactgaggttcaaataggttaagctggcctatggtaactaagtgtaagtgactgagccaggacttaaacgcatgtctgatgcaaatacgtctaaataaaataaacaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccaggtatggacagctgaaagcccaggtcatgaaggcaaggtgacctgagggagagatgggagttcaaaccctaagtaccagggttctagggttacagtttcttcctccagctggactggtatgcctgggtccctaatgctccatgcacaatgcggatgcccccacccaccaacaaggaagatgtgacgawggccacagtgatggggtcactacctgatgtccggcaggcctgtcttcaaatggccatctcatggcatctgagtcgccgccagccagacatggtgagaggggactctcgggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccc

SEQ ID NO: 619 - DNA, 1001 bp, Homo Sapiens
  allele 501: 10-340-238 : polymorphic base A or G
  misc_binding 481..500: 10-340-238.mis1, potential
  misc_binding 502..521: 10-340-238.mis2, potential complement
  primer_bind 264..282: upstream amplification primer
  primer_bind 665..683: downstream amplification primer, complement
  misc_binding 489..513: 10-340-238 potential probe
aataaacaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccaggtatggacagctgaaagcccaggtcatgaaggcaaggtgacctgagggagagatgggagttcaaaccctaagtaccagggttctagggttacagtttcttcctccagctggactggtatgcctgggtccctaatgctccatgcacaatgcggatgcccccacccaccaacaaggaagatgtgacgatggccacagtgatggggtcactacctgatgtccggcaggcctgtcttcaaatggccatctcatggcatctgagtcgccgccagccagacatggtgagaggggactctcrggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctc

SEQ ID NO: 620 - DNA, 1001 bp, Homo Sapiens
  allele 501: 10-342-301 : insertion of A
  misc_binding 481..500: 10-342-301.mis1, potential
  primer_bind 201..220: upstream amplification primer
  primer_bind 606..623: downstream amplification primer, complement
aaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaacaaatgtgctttgtttgagacatgcacagccaggctacagactggatttggcccttgaaccctgcactagcctgaggccctgaccctacttccaaaacatccaagatcatggagcagggggatttcttagaaaaatcagcttacctcagctaactctccattcccaggaactaaccttcatgcctggtggccaatgtacaaattcctgactcagttctttggcaaattccttccacccatatttctcctattcacccatgtaccccaaaagtccctgaataagaatcatgtttttggggcagaatacaaaccactgccccaaaatggcttctttctccaaacagtcccagatgaaaggcacataattcatgtcttaaggctacttttccagcccctttaatactctgggatctatgtgtttcccacattccaagttatctttcacaagccttttaagaacaacatgcacaaaataaatggacaagaactacaa

SEQ ID NO: 621 - DNA, 1001 bp, Homo Sapiens
  allele 501: 10-342-373 : polymorphic base C or T
  misc_binding 481..500: 10-342-373.mis1, potential
  misc_binding 502..521: 10-342-373.mis2, potential complement
  primer_bind 129..148: upstream amplification primer
  primer_bind 534..551: downstream amplification primer, complement
  misc_binding 489..513: 10-342-373 potential probe
tatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaacaaatgtgctttgtttgagacatgcacagccaggctacagactggatttggcccttgaaccctgyactagcctgaggccctgaccctacttccaaaacatccaagatcatggagcagggggatttcttagaaaaatcagcttacctcagctaactctccattcccaggaactaaccttcatgcctggtggccaatgtacaaattcctgactcagttctttggcaaattccttccacccatatttctcctattcacccatgtaccccaaaagtccctgaataagaatcatgtttttggggcagaatacaaaccactgccccaaaatggcttctttctccaaacagtcccagatgaaaggcacataattcatgtcttaaggctacttttccagcccctttaatactctgggatctatgtgtttcccacattccaagttatctttcacaagccttttaagaacaacatgcacaaaataaatggacaagaactacaaagttattctagccaatgatagtgtttatttgttaggtcctggggtctcaaggtcaaatgatccctctcaatt

SEQ ID NO: 622 - DNA, 1001 bp, Homo Sapiens
  allele 501: 10-343-231 : deletion of C
  misc_binding 481..500: 10-343-231.mis1, potential
  primer_bind 271..288: upstream amplification primer
  primer_bind 684..703: downstream amplification primer, complement
ccaatgtaagtatgaggccagaggtcagacgtgaagctcctccaagaaccggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcagctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtcggggaaggaggcacaaggtcccgggaactgctgcggggctaggagggcagagttaaggacggtcggagcagacttagaggatgtatgggcccagggcaggtgaaatgtagggatcccagggtgctggacagaaaacgggaaggagttatgaattcccaaagttttacacaggctaagagaggctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggccc

SEQ ID NO: 623 - DNA, 1001 bp, Homo Sapiens
  allele 501: 10-343-278 : polymorphic base C or T
  misc_binding 481..500: 10-343-278.mis1, potential
  misc_binding 502..521: 10-343-278.mis2, potential complement
  primer_bind 224..241: upstream amplification primer
  primer_bind 637..656: downstream amplification primer, complement
  misc_binding 489..513: 10-343-278 potential probe
accggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcagctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtcggggaaggaggcacaaggtcycgggaactgctgcggggctaggagggcagagttaaggacggtcggagcagacttagaggatgtatgggcccagggcaggtgaaatgtagggatcccagggtgctggacagaaaacgggaaggagttatgaattcccaaagttttacacaggctaagagaggctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagacgaggaggaatgaggatggcaaatagtgaattttttttt

SEQ ID NO: 624 - DNA, 1001 bp, Homo Sapiens
  allele 501: 10-346-141 : polymorphic base A or G
  misc_binding 481..500: 10-346-141.mis1, potential
  misc_binding 502..520: 10-346-141.mis2, complement
  primer_bind 363..381: upstream amplification primer
  primer_bind 763..780: downstream amplification primer, complement
  misc_binding 489..513: 10-346-141 potential probe
gccgtgaggccaattgtcttgatgtctccccagcccgcctgccaggagacaatgctttggacatgttccagaagcatcgagagaaggaactgaaagacagacagcagatctactggtgaccacccaccccttaaactaaccccgccaccactgtcccaccccttccctgcccctgcccctgcccctggccccatcactgaccatgacatccttcctgaagctttgtccccaactcctagctgggccacctggaaggaagggttacccctgaccatcgctgcagaccgtaaggatgatctacctccaaatatgagattccatgaggagaagaggctggactttgaatggacactgaaggcagggtgagaaaaaggctagacctcgaagtgaaataagggctgggagggccaagaatgatgatagacggtgagggactgagggatcagctgatgagttaagcctcaatacctgtcctagggctctggagatggccctcaaacrtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccgcccaccaaagagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcaggtacctctcc

SEQ ID NO: 625 - DNA, 1000 bp, Homo Sapiens
  allele 500: 10-346-23 : polymorphic base A or G
  misc_binding 480..499: 10-346-23.mis1, potential
  misc_binding 501..520: 10-346-23.mis2, potential complement
  primer_bind 478..496: upstream amplification primer
  primer_bind 878..895: downstream amplification primer, complement
  misc_binding 488..512: 10-346-23 potential probe
tggataatcaaatgaggcaaagccagagataaaagcaacagtgcatggctgaaaacatggaatacggctaaccacagggagatgaggacaagaggcgggcataggaccagacagagccgtgaggccaattgtcttgatgtctccccagcccgcctgccaggagacaatgctttggacatgttccagaagcatcgagagaaggaactgaaagacagacagcagatctactggtgaccacccaccccttaaactaaccccgccaccactgtcccaccccttccctgcccctgcccctgcccctggccccatcactgaccatgacatccttcctgaagctttgtccccaactcctagctgggccacctggaaggaagggttacccctgaccatcgctgcagaccgtaaggatgatctacctccaaatatgagattccatgaggagaagaggctggactttgaatggacactgaaggcagggtgagaaaaaggctagacctcgragtgaaataagggctgggagggccaagaatgatgatagacggtgagggactgagggatcagctgatgagttaagcctcaatacctgtcctagggctctggagatggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccgcccaccaaagagaaggttcgccagtgctggcaggatgatgagttgttcagctaccagttcctcaa

SEQ ID NO: 626 - DNA, 1001 bp, Homo Sapiens
  allele 501: 10-346-263 : polymorphic base G or C
  misc_binding 481..500: 10-346-263.mis1, potential
  misc_binding 502..521: 10-346-263.mis2, potential complement
  primer_bind 241..259: upstream amplification primer
  primer_bind 641..658: downstream amplification primer, complement
  misc_binding 489..513: 10-346-263 potential probe
cccaccccttaaactaaccccgccaccactgtcccaccccttccctgcccctgcccctgcccctggccccatcactgaccatgacatccttcctgaagctttgtccccaactcctagctgggccacctggaaggaagggttacccctgaccatcgctgcagaccgtaaggatgatctacctccaaatatgagattccatgaggagaagaggctggactttgaatggacactgaaggcagggtgagaaaaaggctagacctcgaagtgaaataagggctgggagggccaagaatgatgatagacggtgagggactgagggatcagctgatgagttaagcctcaatacctgtcctagggctctggagatggccctcaaacgtgtttacaccctcctgagctcctggaactgcctagaagactttgatcagatcttctggggccagaagagtgccctggctggtcagtggttccccgaggtctccataatcccttaatggcccstctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccgcccaccaaagagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaa

SEQ ID NO: 627 - DNA, 1001 bp, Homo Sapiens
  allele 501: 10-346-305 : polymorphic base C or T
  misc_binding 481..500: 10-346-305.mis1, potential
  misc_binding 502..521: 10-346-305.mis2, potential complement
  primer_bind 199..217: upstream amplification primer
  primer_bind 599..616: downstream amplification primer, complement
  misc_binding 489..513: 10-346-305 potential probe
ccctgcccctgcccctgcccctggccccatcactgaccatgacatccttcctgaagctttgtccccaactcctagctgggccacctggaaggaagggttacccctgaccatcgctgcagaccgtaaggatgatctacctccaaatatgagattccatgaggagaagaggctggactttgaatggacactgaaggcagggtgagaaaaaggctagacctcgaagtgaaataagggctgggagggccaagaatgatgatagacggtgagggactgagggatcagctgatgagttaagcctcaatacctgtcctagggctctggagatggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactcttygcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccgcccaccaaagagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagc

SEQ ID NO: 628 - DNA, 1001 bp, Homo Sapiens
  allele 501: 10-349-216 : deletion of CTG
  misc_binding 481..500: 10-349-216.mis1, potential
  primer_bind 286..305: upstream amplification primer
  primer_bind 683..702: downstream amplification primer, complement
agccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccagccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagatattgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaagggacagcctataacagtatagtattgatgaagaatgtttctacccaattgagga

SEQ ID NO: 629 - DNA, 1001 bp, Homo Sapiens
  allele 501: 10-350-332 : polymorphic base C or T
  misc_binding 481..500: 10-350-332.mis1, potential
  misc_binding 502..521: 10-350-332.mis2, potential complement
  primer_bind 172..189: upstream amplification primer
  primer_bind 513..532: downstream amplification primer, complement
  misc_binding 489..513: 10-350-332 potential probe
gtgagcatcaccacagcccctgagataagagagtctattgctgccccctgttgacaaatgaagagattgcagattaaaaggttattaacttggccaagtctcaaatgaggagtaaagtgtaggttaaaatcctggtcagtctggctccagggcccaactcacagggaagttggagagcacaagagtgagtgatcagaacagcaggagatcagcctgtaaaggaaagcatcaagaggagaaggcgccatgctgggtgccaggccctaccaggaaggacccaagcatggcctccaccagtcacgccctccaatctcctcctctccagttcctgatcccccatatccgctacaccatggaaatcaacacccgggcccggacccaactcatctcagatggaggaatttttgataaggtgaggagggtacggggcatgggactgcctcatccatctctccatgatctgccactttcaggatccaagatcaactatgtgtgaatgtyctcactcttaacctatgaacctgtcccttttatacccatgtctttttttttttttttttttttttgagacagagtctagctctgtcgcccaggttggagtgcagtggcgccatctcggctcactgccatctccgcctcctgggttcaagcgattctcctgcctcagcctcccgagtagctgggattacaggcgcccgccaccatgcccagctaatttttatatttttagtagagatggggtttcactgtgttggccagactggtctcgaactcctgacctcatgatccacccacctcagcctcccaaagtgctgtatacccatgtcttaatatctgaaaatcccacatttgccccactttatggaagatgtgttggttctccagccctgtttccccctctaagacctgtgatctcctgtcccaggcagtgagcacaggtggagggggccatgtacagttgctccgtcgggcggcagctcagctgacctactgctccctct

SEQ ID NO: 630 - DNA, 1001 bp, Homo Sapiens
  allele 501: 10-350-72 : polymorphic base C or T
  misc_binding 481..500: 10-350-72.mis1, potential
  misc_binding 502..521: 10-350-72.mis2, potential complement
  primer_bind 430..447: upstream amplification primer
  primer_bind 771..790: downstream amplification primer, complement
  misc_binding 489..513: 10-350-72 potential probe
tctagttctgacagaaagtattctccccatccatcccctaaagaaacccccaactgtgaaacaactaaaagatggagatgcagctttgatcataagcagagaggctagtttaagaggatgtgaatgacagaggaggtagcaaagaaaatcagaaagggctgattcataaggcacctatactcaaggtagaaacaatgaagcagacagctactattccaggactcttatgtgtaatagacactctccaacatcacttaggtgagcatcaccacagcccctgagataagagagtctattgctgccccctgttgacaaatgaagagattgcagattaaaaggttattaacttggccaagtctcaaatgaggagtaaagtgtaggttaaaatcctggtcagtctggctccagggcccaactcacagggaagttggagagcacaagagtgagtgatcagaacagcaggagatcagcctgtaaaggaaagcatcaagaggagaaggygccatgctgggtgccaggccctaccaggaaggacccaagcatggcctccaccagtcacgccctccaatctcctcctctccagttcctgatcccccatatccgctacaccatggaaatcaacacccgggcccggacccaactcatctcagatggaggaatttttgataaggtgaggagggtacggggcatgggactgcctcatccatctctccatgatctgccactttcaggatccaagatcaactatgtgtgaatgtcctcactcttaacctatgaacctgtcccttttatacccatgtctttttttttttttttttttttttgagacagagtctagctctgtcgcccaggttggagtgcagtggcgccatctcggctcactgccatctccgcctcctgggttcaagcgattctcctgcctcagcctcccgagtagctgggattacaggcgcccgccaccatgcccagctaatttttatatttttagtagagatggggtt

SEQ ID NO: 631 - DNA, 1000 bp, Homo Sapiens
  allele 501: 10-507-170 : polymorphic base A or G
  misc_binding 481..500: 10-507-170.mis1, potential
  misc_binding 502..521: 10-507-170.mis2, potential complement
  primer_bind 332..350: upstream amplification primer
  primer_bind 739..758: downstream amplification primer, complement
  misc_binding 489..513: 10-507-170 potential probe
tctcctgtcccaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtgagtaaggaggagctgagaaatggtggggcggggggggagactgggggaggtgtctggaaaaatcaggattttctgacgatgtatgacagcaaccatgcgaattcctagaactaaggacccacatcttcatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaragggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagccctgcccttctggggacaggaccccagcctctcatcacgcctcccttcctccctccacacgggaaagcatgtgtatcccattcccacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggc

SEQ ID NO: 632 - DNA, 1000 bp, Homo Sapiens
  allele 501: 10-507-321 : polymorphic base A or C
  misc_binding 481..500: 10-507-321.mis1, potential
  misc_binding 502..521: 10-507-321.mis2, potential complement
  primer_bind 181..199: upstream amplification primer
  primer_bind 588..607: downstream amplification primer, complement
  misc_binding 489..513: 10-507-321 potential probe
gatgctttacggctctgggagatcattgccaggtgagtaaggaggagctgagaaatggtggggcggggggggagactgggggaggtgtctggaaaaatcaggattttctgacgatgtatgacagcaaccatgcgaattcctagaactaaggacccacatcttcatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaaagggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagcmctgcccttctggggacaggaccccagcctctcatcacgcctcccttcctccctccacacgggaaagcatgtgtatcccattcccacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatcctt

SEQ ID NO: 633 - DNA, 1000 bp, Homo Sapiens
  allele 501: 10-507-353 : polymorphic base C or T
  misc_binding 481..500: 10-507-353.mis1, potential
  misc_binding 502..521: 10-507-353.mis2, potential complement
  primer_bind 149..167: upstream amplification primer
  primer_bind 556..575: downstream amplification primer, complement
  misc_binding 489..513: 10-507-353 potential probe
gtgagtaaggaggagctgagaaatggtggggcggggggggagactgggggaggtgtctggaaaaatcaggattttctgacgatgtatgacagcaaccatgcgaattcctagaactaaggacccacatcttcatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaaagggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagccctgcccttctggggacaggaccccagcctctyatcacgcctcccttcctccctccacacgggaaagcatgtgtatcccattcccacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatccttggggctcaggtttctttggctaatccaactct

SEQ ID NO: 634 - DNA, 1000 bp, Homo Sapiens
  allele 501: 10-507-364 : polymorphic base C or T
  misc_binding 481..500: 10-507-364.mis1, potential
  misc_binding 502..521: 10-507-364.mis2, potential complement
  primer_bind 138..156: upstream amplification primer
  primer_bind 545..564: downstream amplification primer, complement
  misc_binding 489..513: 10-507-364 potential probe
ggagctgagaaatggtggggcggggggggagactgggggaggtgtctggaaaaatcaggattttctgacgatgtatgacagcaaccatgcgaattcctagaactaaggacccacatcttcatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaaagggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagccctgcccttctggggacaggaccccagcctctcatcacgcctcycttcctccctccacacgggaaagcatgtgtatcccattcccacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatccttggggctcaggtttctttggctaatccaactcttccaccctaac

SEQ ID NO: 635 - DNA, 1000 bp, Homo Sapiens
  allele 501: 10-507-405 : polymorphic base C or T
  misc_binding 481..500: 10-507-405.mis1, potential
  misc_binding 502..521: 10-507-405.mis2, potential complement
  primer_bind 97..115: upstream amplification primer
  primer_bind 504..523: downstream amplification primer, complement
  misc_binding 489..513: 10-507-405 potential probe
gtgtctggaaaaatcaggattttctgacgatgtatgacagcaaccatgcgaattcctagaactaaggacccacatcttcatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaaagggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagccctgcccttctggggacaggaccccagcctctcatcacgcctcccttcctccctccacacgggaaagcatgtgtatcccattccyacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatccttggggctcaggtttctttggctaatccaactcttccaccctaaccaccccttggccaaaatctagccactacctttagtcaactc

SEQ ID NO: 636 - DNA, 1000 bp, Homo Sapiens
  allele 501: 10-508-191 : polymorphic base C or T
  misc_binding 481..500: 10-508-191.mis1, potential
  misc_binding 502..521: 10-508-191.mis2, potential complement
  primer_bind 311..328: upstream amplification primer
  primer_bind 727..746: downstream amplification primer, complement
  misc_binding 489..513: 10-508-191 potential probe
ttaagaccagcctggccaacatggcaaaacctcgtctctactaaaaatacaaaaactagccaggcttggtggtgcacacctgtaatcccagctactcaggaagctgaggcaagagaatcgcttgaacctgggaggtggaggttgcagtgagccgagatcacgccactgcactctagcctgggcaacagagcaagactctatctcaaaaaaaaaagagaagtttttcttctgattaagccagttagctaacatagatggtcatcacaattgccaggtgtctctagactgcactatatgtgacaaatggtgctatcgagtcctcctaaagattatttatagtttatcttgagaacacatatgtaatgggctgtatctgcttggctagataaaagtgagacttccttctgtctttgcagtctcttagcaaactgcctgtgatgtgctcacattctggtttaatgcttattcaataataaaactgttttctttcttcactacttycgtggagaggttttttctgggttgggagaaaattttgcttctaattatattctcccaacatagcgcatgtgcttaaaagggaaacaaaagcaggagggggaagggtctagagtgataagagctctagtgagaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagacaaactcttttctaggcaaaagtaacccacgaaaatgtgtgtggaaaggccagatcctactattaggca

SEQ ID NO: 637 - DNA, 1000 bp, Homo Sapiens
  allele 501: 10-508-245 : polymorphic base C or T
  misc_binding 481..500: 10-508-245.mis1, potential
  misc_binding 502..521: 10-508-245.mis2, potential complement
  primer_bind 257..274: upstream amplification primer
  primer_bind 673..692: downstream amplification primer, complement
  misc_binding 489..513: 10-508-245 potential probe
actagccaggcttggtggtgcacacctgtaatcccagctactcaggaagctgaggcaagagaatcgcttgaacctgggaggtggaggttgcagtgagccgagatcacgccactgcactctagcctgggcaacagagcaagactctatctcaaaaaaaaaagagaagtttttcttctgattaagccagttagctaacatagatggtcatcacaattgccaggtgtctctagactgcactatatgtgacaaatggtgctatcgagtcctcctaaagattatttatagtttatcttgagaacacatatgtaatgggctgtatctgcttggctagataaaagtgagacttccttctgtctttgcagtctcttagcaaactgcctgtgatgtgctcacattctggtttaatgcttattcaataataaaactgttttctttcttcactactttcgtggagaggttttttctgggttgggagaaaattttgcttctaattatattctyccaacatagcgcatgtgcttaaaagggaaacaaaagcaggagggggaagggtctagagtgataagagctctagtgagaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagacaaactcttttctaggcaaaagtaacccacgaaaatgtgtgtggaaaggccagatcctactattaggcaggatgggaatttgagccattttatttggatattacagaatggggtgaccccaga

SEQ ID NO: 638 - DNA, 1001 bp, Homo Sapiens
  allele 501: 10-510-173 : variable motif ATTTA or TTTTTT
  misc_binding 481..500: 10-510-173.mis1, potential
  primer_bind 329..347: upstream amplification primer
  primer_bind 729..748: downstream amplification primer, complement
cattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagacaaactcttttctaggcaaaagtaacccacgaaaatgtgtgtggaaaggccagatcctactattaggcaggatgggaatttgagccattttatttggatattacagaatggggtgaccccagaaaactggaagaactggggaccagcaaatggccgacctgcagtcctgagcagaggatgtaggccagagtggacctagaagataagaaagggaattgaatccagtaagggacagacactttatttttttatttttatttatttatttatttatttttgagatagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagcaggcttcatctgactgattcctgacacgggagagaaagcctaagctccgaatcatccttcaatgtttacaaaggccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacac

SEQ ID NO: 639 - DNA, 1001 bp, Homo Sapiens
  allele 501: 10-511-337 : insertion of T
  misc_binding 481..500: 10-511-337.mis1, potential
  primer_bind 165..182: upstream amplification primer
  primer_bind 569..587: downstream amplification primer, complement
atttatttatttttgagatagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagcaggcttcatctgactgattcctgacacgggagagaaagcctaagctccgaatcatccttcaatgtttacaaaggccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacaccccgactggtgttcctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccgcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgg

SEQ ID NO: 640 - DNA, 1001 bp, Homo Sapiens
  allele 501: 10-512-36 : polymorphic base G or C
  misc_binding 481..500: 10-512-36.mis1, potential
  misc_binding 502..521: 10-512-36.mis2, potential complement
  primer_bind 147..164: upstream amplification primer
  primer_bind 551..569: downstream amplification primer, complement
  misc_binding 489..513: 10-512-36 potential probe
tagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagcaggcttcatctgactgattcctgacacgggagagaaagcctaagctccgaatcatccttcaatgtttacaaaggccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacaccccgactggtgttsctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccgcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcaggcccacctcg

SEQ ID NO: 641 - DNA, 1001 bp, Homo Sapiens
  allele 501: 10-511-62 : polymorphic base C or T
  misc_binding 481..500: 10-511-62.mis1, potential
  misc_binding 502..521: 10-511-62.mis2, potential complement
  primer_bind 440..457: upstream amplification primer
  primer_bind 844..862: downstream amplification primer, complement
  misc_binding 489..513: 10-511-62 potential probe
taggtatgagacaaactcttttctaggcaaaagtaacccacgaaaatgtgtgtggaaaggccagatcctactattaggcaggatgggaatttgagccattttatttggatattacagaatggggtgaccccagaaaactggaagaactggggaccagcaaatggccgacctgcagtcctgagcagaggatgtaggccagagtggacctagaagataagaaagggaattgaatccagtaagggacagacactttatttttttatttttatttatttatttatttatttttgagatagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagyaggcttcatctgactgattcctgacacgggagagaaagcctaagctccgaatcatccttcaatgtttacaaaggccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacaccccgactggtgttcctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcg

SEQ ID NO: 642 - DNA, 1000 bp, Homo Sapiens
  allele 501: 10-512-318 : polymorphic base A or G
  misc_binding 481..500: 10-512-318.mis1, potential
  misc_binding 502..521: 10-512-318.mis2, potential complement
  primer_bind 184..203: upstream amplification primer
  primer_bind 607..626: downstream amplification primer, complement
  misc_binding 489..513: 10-512-318 potential probe
ccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacaccccgactggtgttcctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccrcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcaggcccacctcgatcccgccttcccgggaggtccaggaaggtcccgccgcacccaccccgttggcctcaccctggctcgggcccctttatcatcctgcagctacgctccgaccaggaagcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgca

SEQ ID NO: 643 - DNA, 1001 bp, Homo Sapiens
  allele 501: 10-513-250 : polymorphic base A or G
  misc_binding 481..500: 10-513-250.mis1, potential
  misc_binding 502..521: 10-513-250.mis2, potential complement
  primer_bind 252..269: upstream amplification primer
  primer_bind 660..677: downstream amplification primer, complement
  misc_binding 489..513: 10-513-250 potential probe
actggtgttcctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccgcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcagrcccacctcgatcccgccttcccgggaggtccaggaaggtcccgccgcacccaccccgttggcctcaccctggctcgggcccctttatcatcctgcagctacgctccgaccaggaagcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggtcagcgcggggagcgaggggagctagggcagcgg

SEQ ID NO: 644 - DNA, 1001 bp, Homo Sapiens
  allele 501: 10-513-262 : polymorphic base C or T
  misc_binding 481..500: 10-513-262.mis1, potential
  misc_binding 502..521: 10-513-262.mis2, potential complement
  primer_bind 240..257: upstream amplification primer
  primer_bind 648..665: downstream amplification primer, complement
  misc_binding 489..513: 10-513-262 potential probe
gggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccgcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcaggcccacctcgatyccgccttcccgggaggtccaggaaggtcccgccgcacccaccccgttggcctcaccctggctcgggcccctttatcatcctgcagctacgctccgaccaggaagcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggtcagcgcggggagcgaggggagctagggcagcggggaccccgggcc

SEQ ID NO: 645 - DNA, 1001 bp, Homo Sapiens
  allele 501: 10-513-352 : polymorphic base A or G
  misc_binding 481..500: 10-513-352.mis1, potential
  misc_binding 502..521: 10-513-352.mis2, potential complement
  primer_bind 150..167: upstream amplification primer
  primer_bind 558..575: downstream amplification primer, complement
  misc_binding 489..513: 10-513-352 potential probe
catgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccgcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcaggcccacctcgatcccgccttcccgggaggtccaggaaggtcccgccgcacccaccccgttggcctcaccctggctcgggcccctttatcatcctgcagctacrctccgaccaggaagcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggtcagcgcggggagcgaggggagctagggcagcggggaccccgggcccaggcccgggccgagctgggctcgcggcgggagggcgggaggctgggggcgaggtgacagcgcgacctcgcggactgggacttccacgaa

SEQ ID NO: 646 - DNA, 1001 bp, Homo Sapiens
  allele 501: 10-513-365 : polymorphic base A or G
  misc_binding 481..500: 10-513-365.mis1, potential
  misc_binding 502..521: 10-513-365.mis2, potential complement
  primer_bind 137..154: upstream amplification primer
  primer_bind 545..562: downstream amplification primer, complement
  misc_binding 489..513: 10-513-365 potential probe
gtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccgcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcaggcccacctcgatcccgccttcccgggaggtccaggaaggtcccgccgcacccaccccgttggcctcaccctggctcgggcccctttatcatcctgcagctacgctccgaccaggargcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggtcagcgcggggagcgaggggagctagggcagcggggaccccgggcccaggcccgggccgagctgggctcgcggcgggagggcgggaggctgggggcgaggtgacagcgcgacctcgcggactgggacttccacgaagctgggacgaggt

SEQ ID NO: 647 - DNA, 1000 bp, Homo Sapiens
  allele 501: 10-517-100 : polymorphic base G or C
  misc_binding 481..500: 10-517-100.mis1, potential
  misc_binding 502..521: 10-517-100.mis2, potential complement
  primer_bind 402..420: upstream amplification primer
  primer_bind 722..740: downstream amplification primer, complement
  misc_binding 489..513: 10-517-100 potential probe
tagcagcacgtagggtgattaaaactccagactttaaagccagaccggcctgggcttgaacccttgttctgctccttgctatgtgggtctttgccttgaccacattttttttttttttttaagacaggatctccctctcttgcccaggctgtaatgcagtgttgcgatcacagctcactgaagcctccatctctacagcctcaagcgatcctcctgcctcagccccgagtagctgggactacaggtctgtgccaccacgtccagctaatttacttttgtagagttgggggtcttgctatgttgcccaggctgttctccaactcctggactcaagccatcctctagcctcggccttccaaagtgctgggactataggcgtgagccacggtgccaggcccttgaccacatttttaacccctctgaacctcagtttcactttctgggcaatgggaggggggtaatttgtccctcagagggttgcactgaggggcaaatgtgagsctctgggtacaatgcccagtacagactaggtccccacgacacagccgctcagcggctccggattctgggctgctctggactgcggccaggcggtcttctgcgggaatccgggcaggcagggcgggctgcgctcccctccccggctctcccggtgccccttgtctttttgttctgtctcagcagctctctattaagatgaatggcatttccaaaggcttcacctctgataagtgttcctctgcagctgcagccagaatcttaatgtgcgcgctgtaatttaatggccgtctcggctattaacacgctcttctcgggtgaagtggactccctccatccccgggcctctgcacgtgctctgcgcactggctgggggtgactccaaggagctcagagcggggtgcccggcacctctcgccaggcgcctttcgaccttctaaagcgcgaatggctggacttttctcccatgtgtggggccccagaaggtgtggggccccagaag

SEQ ID NO: 648 - DNA, 1000 bp, Homo Sapiens
  allele 501: 10-518-125 : polymorphic base G or T
  misc_binding 481..500: 10-518-125.mis1, potential
  misc_binding 502..521: 10-518-125.mis2, potential complement
  primer_bind 378..396: upstream amplification primer
  primer_bind 630..648: downstream amplification primer, complement
  misc_binding 489..513: 10-518-125 potential probe
tgctatgttgcccaggctgttctccaactcctggactcaagccatcctctagcctcggccttccaaagtgctgggactataggcgtgagccacggtgccaggcccttgaccacatttttaacccctctgaacctcagtttcactttctgggcaatgggaggggggtaatttgtccctcagagggttgcactgaggggcaaatgtgaggctctgggtacaatgcccagtacagactaggtccccacgacacagccgctcagcggctccggattctgggctgctctggactgcggccaggcggtcttctgcgggaatccgggcaggcagggcgggctgcgctcccctccccggctctcccggtgccccttgtctttttgttctgtctcagcagctctctattaagatgaatggcatttccaaaggcttcacctctgataagtgttcctctgcagctgcagccagaatcttaatgtgcgcgctgtaatttaatggccgtctcgkctattaacacgctcttctcgggtgaagtggactccctccatccccgggcctctgcacgtgctctgcgcactggctgggggtgactccaaggagctcagagcggggtgcccggcacctctcgccaggcgcctttcgaccttctaaagcgcgaatggctggacttttctcccatgtgtggggccccagaaggtgtggggccccagaaggtgtggggtccctgcgttccacggagcccggaaggtttccagtgatggtgggggctgaccacgttggtccccgtgggtgctgttttcatgtgccggcagattgggatgagtttaaaagacagaagcgtgtaggatagagaaacttctttaaaaactggaaattttaatctggggattataactattggacagtcaagtgcaagagtgaatacacttctcactccctcctcccaatttttatttgcgggattagtcagtccccctctgccacatgataattgtgagaactacca

SEQ ID NO: 649 - DNA, 1000 bp, Homo Sapiens
  allele 501: 10-518-194 : polymorphic base A or G
  misc_binding 481..500: 10-518-194.mis1, potential
  misc_binding 502..521: 10-518-194.mis2, potential complement
  primer_bind 309..327: upstream amplification primer
  primer_bind 561..579: downstream amplification primer, complement
  misc_binding 489..513: 10-518-194 potential probe
gctgggactataggcgtgagccacggtgccaggcccttgaccacatttttaacccctctgaacctcagtttcactttctgggcaatgggaggggggtaatttgtccctcagagggttgcactgaggggcaaatgtgaggctctgggtacaatgcccagtacagactaggtccccacgacacagccgctcagcggctccggattctgggctgctctggactgcggccaggcggtcttctgcgggaatccgggcaggcagggcgggctgcgctcccctccccggctctcccggtgccccttgtctttttgttctgtctcagcagctctctattaagatgaatggcatttccaaaggcttcacctctgataagtgttcctctgcagctgcagccagaatcttaatgtgcgcgctgtaatttaatggccgtctcggctattaacacgctcttctcgggtgaagtggactccctccatccccgggcctctgcacgtgctctgcgcrctggctgggggtgactccaaggagctcagagcggggtgcccggcacctctcgccaggcgcctttcgaccttctaaagcgcgaatggctggacttttctcccatgtgtggggccccagaaggtgtggggccccagaaggtgtggggtccctgcgttccacggagcccggaaggtttccagtgatggtgggggctgaccacgttggtccccgtgggtgctgttttcatgtgccggcagattgggatgagtttaaaagacagaagcgtgtaggatagagaaacttctttaaaaactggaaattttaatctggggattataactattggacagtcaagtgcaagagtgaatacacttctcactccctcctcccaatttttatttgcgggattagtcagtccccctctgccacatgataattgtgagaactaccagggtcttcattctcctgccatctggttgacctctccaagaatggacacccgggcagcctgggccaatga

SEQ ID NO: 650 - DNA, 1000 bp, Homo Sapiens
  allele 501: 10-522-71 : polymorphic base A or G
  misc_binding 481..500: 10-522-71.mis1, potential
  misc_binding 502..521: 10-522-71.mis2, potential complement
  primer_bind 431..449: upstream amplification primer
  primer_bind 885..903: downstream amplification primer, complement
  misc_binding 489..513: 10-522-71 potential probe
gaggccgaggcgggcagatcacgaggtcaggagatcgagaccatcccggctaacacggtgaaacccccgtctctactaaaaaatataaaaaaaattagccaggcgtggtggtgggtgcctgtagtcccagctactgaggaggctgagacaggagaatggcgtgaacccgggaggcagagcttgcagtgagctgagatcgcgccactgcactccagcctgggcaacagagcaagactccgtctcaaaaaaaaaaaaaaaaaagagaggaagggcgggagagagagagagagaaagctctctagctccaaggcctaaccacatctctgttcttttcaacttcagctgtcagatttttagactctttgagtgaataaattctcctttttgcttaaactagtttgagctaagtttctattgcttgcaactggaatactttgtaagaggactggccttcatttctgatgcattgtcactaagatgtaagtgttagaagagctaacrctttatggggttcaaactccttggctaccaaaacctaaacatcccctgaaacttaccaaactgcaggtatgaattggatctcactaaggtgaatatacaaatcttgcaagtgctgagccctaaccaatcttgtaataactctgtggtagttaattttatgtcaaattgattgagctaaaaaatgcccaggtagctggtaaaatgtttttttctgggtgtgttagggagggtgtttctgaaagagatcagcactggaatcagcggactaagtaaagaattcccaccctcaccaatatggtgggtgtcatcaatccactgagggcctgaatagaacaaaaagcgggcagaagggcaaattccctcttcttcttgagctgggccatccatcttctcctgcccttggacactggagccccttgttctccagcttttggattcagactgggtcttgcaccattgccctccatcttctcctgcccttggacactggagccccttg

SEQ ID NO: 651 - DNA, 20674 bp, Homo sapiens
  misc_feature 1123..3123: 5'regulatory region
  exon 3124..3297: exon 1
  exon 3871..4072: exon 2
  exon 5552..5633: exon 3
  exon 5758..5880: exon 4
  exon 5996..6099: exon 5
  exon 6349..6509: exon 6
  exon 7379..7522: exon 7
  exon 8645..8854: exon 8
  exon 12254..12340: exon 9
  exon 12854..13023: exon 10
  exon 13308..13429: exon 11
  exon 16567..16667: exon 12
  exon 16775..16945: exon 13
  exon 17063..17554: exon 14
  misc_feature 17555..20674: 3'regulatory region
  allele 1128: 10-508-191  : polymorphic base C or T
  allele 1182: 10-508-245  : polymorphic base C or T
  allele 1559: 10-509-284  : polymorphic base C or T
  allele 1570: 10-509-295  : deletion of C
  allele 1827: 10-510-173  : variable motif ATTTA or TTTTTT
  allele 2048: 10-511-62  : polymorphic base C or T
  allele 2323: 10-511-337  : insertion of T
  allele 2341: 10-512-36  : polymorphic base G or C
  allele 2623: 10-512-318  : polymorphic base A or G
  allele 2832: 10-513-250  : polymorphic base A or G
  allele 2844: 10-513-262  : polymorphic base C or T
  allele 2934: 10-513-352  : polymorphic base A or G
  allele 2947: 10-513-365  : polymorphic base A or G
  allele 3802: 12-206-81  : polymorphic base A or G
  allele 4062: 10-343-231  : deletion of C
  allele 4088: 12-206-366  : polymorphic base C or T
  allele 4109: 10-343-278  : polymorphic base C or T
  allele 4170: 10-343-339  : polymorphic base G or T
  allele 5903: 10-346-23  : polymorphic base A or G
  allele 6019: 10-346-141  : polymorphic base A or G
  allele 6141: 10-346-263  : polymorphic base G or C
  allele 6183: 10-346-305  : polymorphic base C or T
  allele 6338: 10-347-74  : polymorphic base A or G
  allele 6375: 10-347-111  : polymorphic base G or C
  allele 6429: 10-347-165  : polymorphic base C or T
  allele 6467: 10-347-203  : polymorphic base A or G
  allele 6484: 10-347-220  : polymorphic base A or G
  allele 6534: 10-347-271  : polymorphic base A or T
  allele 6611: 10-347-348  : polymorphic base A or G
  allele 7668: 10-348-391  : polymorphic base A or G
  allele 8608: 10-349-47  : polymorphic base C or T
  allele 8658: 10-349-97  : polymorphic base A or G
  allele 8703: 10-349-142  : polymorphic base G or C
  allele 8777: 10-349-216  : deletion of CTG
  allele 8785: 10-349-224  : polymorphic base G or T
  allele 8926: 10-349-368  : polymorphic base C or T
  allele 12171: 10-350-72  : polymorphic base C or T
  allele 12429: 10-350-332  : polymorphic base C or T
  allele 13341: 10-507-170  : polymorphic base A or G
  allele 13492: 10-507-321  : polymorphic base A or C
  allele 13524: 10-507-353  : polymorphic base C or T
  allele 13535: 10-507-364  : polymorphic base C or T
  allele 13576: 10-507-405  : polymorphic base C or T
  allele 15194: 12-220-48  : polymorphic base A or G
  allele 16468: 10-339-32  : polymorphic base C or T
  allele 16559: 10-339-124  : polymorphic base C or T
  allele 16836: 10-340-112  : polymorphic base A or C
  allele 16854: 10-340-130  : polymorphic base A or T
  allele 16962: 10-340-238  : polymorphic base A or G
  allele 17152: 10-341-116  : polymorphic base A or G
  allele 17355: 10-341-319  : polymorphic base C or T
  allele 17623: 10-342-301  : insertion of A
  allele 17695: 10-342-373  : polymorphic base C or T
  primer_bind 938..955: 10-508.pu
  primer_bind 1276..1293: 10-509.pu
  primer_bind 1354..1373: 10-508.rp  complement
  primer_bind 1655..1673: 10-510.pu
  primer_bind 1676..1695: 10-509.rp  complement
  primer_bind 1987..2004: 10-511.pu
  primer_bind 2055..2074: 10-510.rp  complement
  primer_bind 2306..2325: 10-512.pu
  primer_bind 2391..2409: 10-511.rp  complement
  primer_bind 2583..2600: 10-513.pu
  primer_bind 2729..2748: 10-512.rp  complement
  primer_bind 2991..3008: 10-513.rp  complement
  primer_bind 3722..3739: 12-206.pu
  primer_bind 3832..3849: 10-343.pu
  primer_bind 4159..4178: 12-206.rp  complement
  primer_bind 4245..4264: 10-343.rp  complement
  primer_bind 5881..5899: 10-346.pu
  primer_bind 6265..6282: 10-347.pu
  primer_bind 6281..6298: 10-346.rp  complement
  primer_bind 6686..6705: 10-347.rp  complement
  primer_bind 7280..7299: 10-348.pu
  primer_bind 7678..7697: 10-348.rp  complement
  primer_bind 8562..8581: 10-349.pu
  primer_bind 8959..8978: 10-349.rp  complement
  primer_bind 12100..12117: 10-350.pu
  primer_bind 12441..12460: 10-350.rp  complement
  primer_bind 13172..13190: 10-507.pu
  primer_bind 13579..13598: 10-507.rp  complement
  primer_bind 14792..14812: 12-220.rp
  primer_bind 15221..15241: 12-220.pu complement
  primer_bind 16437..16454: 10-339.pu
  primer_bind 16725..16743: 10-340.pu
  primer_bind 16834..16853: 10-339.rp  complement
  primer_bind 17037..17054: 10-341.pu
  primer_bind 17126..17144: 10-340.rp  complement
  primer_bind 17323..17342: 10-342.pu
  primer_bind 17445..17463: 10-341.rp  complement
  primer_bind 17728..17745: 10-342.rp  complement
  primer_bind 1109..1127: 10-508-191.mis
  primer_bind 1129..1147: 10-508-191.mis complement
  primer_bind 1163..1181: 10-508-245.mis
  primer_bind 1183..1201: 10-508-245.mis complement
  primer_bind 1540..1558: 10-509-284.mis
  primer_bind 1560..1578: 10-509-284.mis complement
  primer_bind 2029..2047: 10-511-62.mis
  primer_bind 2049..2067: 10-511-62.mis complement
  primer_bind 2322..2340: 10-512-36.mis
  primer_bind 2342..2360: 10-512-36.mis complement
  primer_bind 2604..2622: 10-512-318.mis
  primer_bind 2624..2642: 10-512-318.mis complement
  primer_bind 2813..2831: 10-513-250.mis
  primer_bind 2825..2843: 10-513-262.mis
  primer_bind 2833..2851: 10-513-250.mis complement
  primer_bind 2845..2863: 10-513-262.mis complement
  primer_bind 2915..2933: 10-513-352.mis
  primer_bind 2928..2946: 10-513-365.mis
  primer_bind 2935..2953: 10-513-352.mis complement
  primer_bind 2948..2966: 10-513-365.mis complement
  primer_bind 3783..3801: 12-206-81.mis
  primer_bind 3803..3821: 12-206-81.mis complement
  primer_bind 4069..4087: 12-206-366.mis
  primer_bind 4089..4107: 12-206-366.mis complement
  primer_bind 4090..4108: 10-343-278.mis
  primer_bind 4110..4128: 10-343-278.mis complement
  primer_bind 4151..4169: 10-343-339.mis
  primer_bind 4171..4189: 10-343-339.mis complement
  primer_bind 5884..5902: 10-346-23.mis
  primer_bind 5904..5922: 10-346-23.mis complement
  primer_bind 6000..6018: 10-346-141.mis
  primer_bind 6020..6038: 10-346-141.mis complement
  primer_bind 6122..6140: 10-346-263.mis
  primer_bind 6142..6160: 10-346-263.mis complement
  primer_bind 6164..6182: 10-346-305.mis
  primer_bind 6184..6202: 10-346-305.mis complement
  primer_bind 6319..6337: 10-347-74.mis
  primer_bind 6339..6357: 10-347-74.mis complement
  primer_bind 6356..6374: 10-347-111.mis
  primer_bind 6376..6394: 10-347-111.mis complement
  primer_bind 6410..6428: 10-347-165.mis
  primer_bind 6430..6448: 10-347-165.mis complement
  primer_bind 6448..6466: 10-347-203.mis
  primer_bind 6465..6483: 10-347-220.mis
  primer_bind 6468..6486: 10-347-203.mis complement
  primer_bind 6485..6503: 10-347-220.mis complement
  primer_bind 6515..6533: 10-347-271.mis
  primer_bind 6535..6553: 10-347-271.mis complement
  primer_bind 6592..6610: 10-347-348.mis
  primer_bind 6612..6630: 10-347-348.mis complement
  primer_bind 7649..7667: 10-348-391.mis
  primer_bind 7669..7687: 10-348-391.mis complement
  primer_bind 8589..8607: 10-349-47.mis
  primer_bind 8609..8627: 10-349-47.mis complement
  primer_bind 8639..8657: 10-349-97.mis
  primer_bind 8659..8677: 10-349-97.mis complement
  primer_bind 8684..8702: 10-349-142.mis
  primer_bind 8704..8722: 10-349-142.mis complement
  primer_bind 8766..8784: 10-349-224.mis
  primer_bind 8786..8804: 10-349-224.mis complement
  primer_bind 8907..8925: 10-349-368.mis
  primer_bind 8927..8945: 10-349-368.mis complement
  primer_bind 12152..12170: 10-350-72.mis
  primer_bind 12172..12190: 10-350-72.mis complement
  primer_bind 12410..12428: 10-350-332.mis
  primer_bind 12430..12448: 10-350-332.mis complement
  primer_bind 13322..13340: 10-507-170.mis
  primer_bind 13342..13360: 10-507-170.mis complement
  primer_bind 13473..13491: 10-507-321.mis
  primer_bind 13493..13511: 10-507-321.mis complement
  primer_bind 13505..13523: 10-507-353.mis
  primer_bind 13516..13534: 10-507-364.mis
  primer_bind 13525..13543: 10-507-353.mis complement
  primer_bind 13536..13554: 10-507-364.mis complement
  primer_bind 13557..13575: 10-507-405.mis
  primer_bind 13577..13595: 10-507-405.mis complement
  primer_bind 15175..15193: 12-220-48.mis
  primer_bind 15195..15213: 12-220-48.mis complement
  primer_bind 16449..16467: 10-339-32.mis
  primer_bind 16469..16487: 10-339-32.mis complement
  primer_bind 16540..16558: 10-339-124.mis
  primer_bind 16560..16578: 10-339-124.mis complement
  primer_bind 16817..16835: 10-340-112.mis
  primer_bind 16835..16853: 10-340-130.mis
  primer_bind 16837..16855: 10-340-112.mis complement
  primer_bind 16855..16873: 10-340-130.mis complement
  primer_bind 16943..16961: 10-340-238.mis
  primer_bind 16963..16981: 10-340-238.mis complement
  primer_bind 17133..17151: 10-341-116.mis
  primer_bind 17153..17171: 10-341-116.mis complement
  primer_bind 17336..17354: 10-341-319.mis
  primer_bind 17356..17374: 10-341-319.mis complement
  primer_bind 17676..17694: 10-342-373.mis
  primer_bind 17696..17714: 10-342-373.mis complement
  misc_binding 1116..1140: 10-508-191.probe
  misc_binding 1170..1194: 10-508-245.probe
  misc_binding 1547..1571: 10-509-284.probe
  misc_binding 2036..2060: 10-511-62.probe
  misc_binding 2329..2353: 10-512-36.probe
  misc_binding 2611..2635: 10-512-318.probe
  misc_binding 2820..2844: 10-513-250.probe
  misc_binding 2832..2856: 10-513-262.probe
  misc_binding 2922..2946: 10-513-352.probe
  misc_binding 2935..2959: 10-513-365.probe
  misc_binding 3790..3814: 12-206-81.probe
  misc_binding 4076..4100: 12-206-366.probe
  misc_binding 4097..4121: 10-343-278.probe
  misc_binding 4158..4182: 10-343-339.probe
  misc_binding 5891..5915: 10-346-23.probe
  misc_binding 6007..6031: 10-346-141.probe
  misc_binding 6129..6153: 10-346-263.probe
  misc_binding 6171..6195: 10-346-305.probe
  misc_binding 6326..6350: 10-347-74.probe
  misc_binding 6363..6387: 10-347-111.probe
  misc_binding 6417..6441: 10-347-165.probe
  misc_binding 6455..6479: 10-347-203.probe
  misc_binding 6472..6496: 10-347-220.probe
  misc_binding 6522..6546: 10-347-271.probe
  misc_binding 6599..6623: 10-347-348.probe
  misc_binding 7656..7680: 10-348-391.probe
  misc_binding 8596..8620: 10-349-47.probe
  misc_binding 8646..8670: 10-349-97.probe
  misc_binding 8691..8715: 10-349-142.probe
  misc_binding 8773..8797: 10-349-224.probe
  misc_binding 8914..8938: 10-349-368.probe
  misc_binding 12159..12183: 10-350-72.probe
  misc_binding 12417..12441: 10-350-332.probe
  misc_binding 13329..13353: 10-507-170.probe
  misc_binding 13480..13504: 10-507-321.probe
  misc_binding 13512..13536: 10-507-353.probe
  misc_binding 13523..13547: 10-507-364.probe
  misc_binding 13564..13588: 10-507-405.probe
  misc_binding 15182..15206: 12-220-48.probe
  misc_binding 16456..16480: 10-339-32.probe
  misc_binding 16547..16571: 10-339-124.probe
  misc_binding 16824..16848: 10-340-112.probe
  misc_binding 16842..16866: 10-340-130.probe
  misc_binding 16950..16974: 10-340-238.probe
  misc_binding 17140..17164: 10-341-116.probe
  misc_binding 17343..17367: 10-341-319.probe
  misc_binding 17683..17707: 10-342-373.probe
tttttttttttttttgagacaaagtctcactcttgttgcccaggctggagtacagtggcacaatctcagctcaccgcaacctccgcctcccgggttcaagcaattctcctgcctcagcctcccaagtaggtgggattacaggcatcctctaccacgcctggctaattttttgtatttttagtagagatggggtttccccatgttggccagactggtctcaaactcctgacctcaggtgatccacccacctcagcctcccaaagtgcggggattacaggcgtgagccaccgcacccagccagaaaacttgtaagttattttctgtgtcttcaaaacgtgtataaatatttttagaagccacacagcctcttgccagctttactacccagggatgtctttcacaaagacccaggagccatctccttgaaatgtaaacaccaagaaagatggagccttcatttcccagtttctgtgggagggtaggactaacttaaatggacactttgcttgagctgcaaaactatctgctgtcataaaaatctgaaaagctggctgggcatggtggctcacgcctgtaatcccagcactttgggaagccgaggtgggtggatcatctgaggtcaggagtttaagaccagcctggccaacatggcaaaacctcgtctctactaaaaatacaaaaactagccaggcttggtggtgcacacctgtaatcccagctactcaggaagctgaggcaagagaatcgcttgaacctgggaggtggaggttgcagtgagccgagatcacgccactgcactctagcctgggcaacagagcaagactctatctcaaaaaaaaaagagaagtttttcttctgattaagccagttagctaacatagatggtcatcacaattgccaggtgtctctagactgcactatatgtgacaaatggtgctatcgagtcctcctaaagattatttatagtttatcttgagaacacatatgtaatgggctgtatctgcttggctagataaaagtgagacttccttctgtctttgcagtctcttagcaaactgcctgtgatgtgctcacattctggtttaatgcttattcaataataaaactgttttctttcttcactacttycgtggagaggttttttctgggttgggagaaaattttgcttctaattatattctyccaacatagcgcatgtgcttaaaagggaaacaaaagcaggagggggaagggtctagagtgataagagctctagtgagaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagayaaactcttttctaggcaaaagtaacccacgaaaatgtgtgtggaaaggccagatcctactattaggcaggatgggaatttgagccattttatttggatattacagaatggggtgaccccagaaaactggaagaactggggaccagcaaatggccgacctgcagtcctgagcagaggatgtaggccagagtggacctagaagataagaaagggaattgaatccagtaagggacagacactttatttttttatttttatttatttatttatttatttttgagatagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagyaggcttcatctgactgattcctgacacgggagagaaagcctaagctccgaatcatccttcaatgtttacaaaggccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacaccccgactggtgttsctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccrcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcagrcccacctcgatyccgccttcccgggaggtccaggaaggtcccgccgcacccaccccgttggcctcaccctggctcgggcccctttatcatcctgcagctacrctccgaccaggargcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggtcagcgcggggagcgaggggagctagggcagcggggaccccgggcccaggcccgggccgagctgggctcgcggcgggagggcgggaggctgggggcgaggtgacagcgcgacctcgcggactgggacttccacgaagctgggacgaggtgggcaagatcagggacagggtccgcagctgggatcccgggctgggctcaaccccatctccctttcccgcccctggtcccggcagcccccagctccttctcccagtgacccagagccaatgtaagtatgaggccagaggtcagacgtgaagctcctccaagaaccggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcrgctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtyggggaaggaggcacaaggtcycgggaactgctgcggggctaggagggcagagttaaggacggtcggagcagacttagaggakgtatgggcccagggcaggtgaaatgtagggatcccagggtgctggacagaaaacgggaaggagttatgaattcccaaagttttacacaggctaagagaggctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagacgaggaggaatgaggatggcaaatagtgaatttttttttttttttttttgagatggagtcttgctttgttgcccaggctggagtgcagtggcgcgatcttggctcactgcaacctccacctcctgggttcacgccattctcctgcctcagcctcccgagtagctgggactacaggcaccccccaccacacccggctaattttttatattttttttagtagagatggagtttcaccgtattagccaggatggtctcgatctcctgacctcgtgatccgccctccttggcctctcaaagtgctgggattacaggcttgagccaccacgcccggcccaaatagtgaatttttaaccatgggtaatgagtaaaagagagatgaatccagagatgagtgagggcagtagggatggaacatcaaatctatgactttgagacaggtgagtgtaaatgcagaaaagacccagaataagtccatagatacagattatgatagtaaatccagaaagatgaggtttaaaaaaaaaaaagcaaatgtagaatcttttgaggacaggtgaaggcgtggcaggtgaggtttaagatgtgaaattaatcaaagcaatctgtagtagacagtaggtgtaggtgtataggtgactaagatttcatcaccttaattaaggtgatttttttccaaccatagatattgatgaagtaaggccaggtaggggaagatgagtgaaggagcaagaaatggtggcaaacaggaggtttttattacaggcaaaggatgagggctgaaataagagaaagcaggagtgcaaagttggcaaagatgggataaacgtgtctggtggataatcaaatgaggcaaagccagagataaaagcaacagtgcatggctgaaaacatggaatacggctaaccacagggagatgaggacaagaggcgggcataggaccagacagagccgtgaggccaattgtcttgatgtctccccagcccgcctgccaggagacaatgctttggacatgttccagaagcatcgagagaaggaactgaaagacagacagcagatctactggtgaccacccaccccttaaactaaccccgccaccactgtcccaccccttccctgcccctgcccctgcccctggccccatcactgaccatgacatccttcctgaagctttgtccccaactcctagctgggccacctggaaggaagggttacccctgaccatcgctgcagaccgtaaggatgatctacctccaaatatgagattccatgaggagaagaggctggactttgaatggacactgaaggcagggtgagaaaaaggctagacctcgragtgaaataagggctgggagggccaagaatgatgatagacggtgagggactgagggatcagctgatgagttaagcctcaatacctgtcctagggctctggagatggccctcaaacrtgtttacaccctcctgagctcctggaactgcctagaagactttgatcagatcttctggggccagaagagtgccctggctggtcagtggttccccgaggtctccataatcccttaatggcccstctggatgactcatcacactccacagtcccccgtaactcttygcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccrcccaccaaagagaaggttcgccagtgctggcaggatsatgagttgttcagctaccagttcctcaatggtgccaaccccatgctgttgagaygctcgacctctctgccctccaggctagtgctgccctcrgggatggaagagcttcrggctcaactggagaaagaacttcaggtacctctccttcccctgcctggcwctgttctctccttagtagtgtggtgagaacggacagagagaatccaaactgagtcagaggaaggctgcagtactgcrttgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctaggcaaaatgtgtgcgtatgcatgtgtgtgctgtatgcggtggcaggggtagtaggggaagctctctggaatatttggcagaggacgtgagatttgaatagggaatgaaagagcatttgctgagctgataggagccaaaaccagagcgcagaccattcgggaatgatcagaaaggggcctggccatttgacaggtggtcagtttacaatgcctgtgatgccaactggattgagcaggcctggttccaaacccagatctgccaccacatccacacacaagacatctaccctcaccagactgtttcttcactttaagatgagaggaactggaccaggggctctagttctcccaacagggctccggtactgatgcaggagaatggcaagaagctagactaaatctcttgccctttgccccggccccctgggggtagactttgaactctaaaaatggatacatccctcctgtccccagaatggttccctgtttgaagctgacttcatccttctggatggaattccagccaacgtgatccgaggagagaagcaatacctggctgcccccctcgttatgctgaagatggagcccaatgggaagctgcagcccatggtcatccaggtaagggccccagacctctcccacaacgttgcactctgttcacctcaacctctgctcccagggacccaacccccagctcttggctcccaaaccccatcctcactcagtgagacttgtcttcatgtcactatttgcctgtaccctcrtctcccctgcctcatccaactagaattactttttcaagagtcaaaatggcctcttggagttctcatcctgtatccaatggtcctcacacttcagtgtgcatcagaatcacctgaatgcctgttgaaatgcagatttctggatcccatgaccagactttctgattcagtatgtctggggtgggaactaagagtttgcgtttttataagttccaaagtgatgctgacactaccagttcaggactacactttcagaatcactatctcatctctcagtggcctctggctctgaaccctcgccatctcttgaatatcttttctcgcaatttcttttttttttttgagacagaatctcactgtgtcactcaggctggaatacagttgtgtgatcttggctcactgcaacctgcgcctcctgggttcaagcaattctcccacctcagtccctccagtagctgggaccacaggcatgtgccaccatgtgggcctggctaatttttgtattttttgtagagatggggtttcgccatattgcccaggctggtcttgaacttctgggctcaagtaatctgcctgcctcggcctcccaaagtgctgggattacagctgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatayacggaatgggagttcaataatttctctttctcccagattcagcctcccarccccagctctccaaccccaacactgttcctgccctcagacccccsacttgcctggctcctggcaaagtcctgggtccgaaattcagatttccaactgcacgagatccagtatcacttgctgaacackcacctggtggctgaggtcatcgctgtcgccaccatgcggtgcctcccaggactgcaccccatcttcaaggtacttattaatctattaaatcacatatccctcagaccccagagagaggaacagccccatatcaaaagataytgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaagggacagcctataacagtatagtattgatgaagaatgtttctacccaattgaggagtcagctaagtagaaacagaccaaaaggcaaggaagaacagccagcaagccgctcatacctgcccaacagtaaggtggatagagatgtatgttagcatggtaatgacaggaatgaaaaggaaagaatctaaaacgtagtgaagggaggaaatggtagctgcagcgtgcctgggtgcaagagagagaaaagccagaagtccaagcttctgccacacctgtaagtccctggggcaggtgtgttatactgacctagaaatactgtggttttaagagctgggtgtggtggttcacgcctgtaatcccagtgctttgggtggccaaagcagtatgattgcttaagaccaggagttcaagaccagcctgggcaacacagcaagtcccggtctctaaataaaaagaaagaaagaaagaaatactgtaattttataaaacagtgagttccatatatattgctgggagaaggcaaaataagacctgtgcttgcttaagaaaatgttcttaaaatcttgatgatactttatatacagggaacttggcagagggagcacaaaaatgatacaagcttacaaaccagagtaattgtcagaaacagtaaagttagaagaaaccagagtcagcaaaaatgaggtgtttggttttaggtacatggagtttgatgtattggcaagatatgcaagtatgtcctgggtaaaaacaaccaaattgtgtttcagctgggggcctccaccaagaccccccaagcctggccagtatagctgtgccgcctctggaattttccccttcggtaacatagacaagatggagaccagtctgatgaatggaatcttggatttcattcatctcatgctgtctcctgcttccccatcctctgctccacacgaacaagtgaagcctctattcacacttacaattccttttcctagttcagtcctctccgtgtctccactcaccacagtaatgccatgccccagcggacagctgagttgctggcagatgcacacaagggtcaagcctgcacatgtcttaacagtggcctatgcaggctctgactttggattgctggggtcttagtcctgaaccccggcctcaataatttccagatgtcctcacatgttccatcgtgaggttattaaaggttaaaatgacttaatggtgtgacacaagctaaatgctacaaaaaacattagttcttgcaaatttttttttttcagagacaagttctcactctgtcacccaggctggagtccagtggcgtaatcataactcactgcagcttcaaactcctgggctgaagcgatcctctaacctcagccttcagagtagctgggactacaggtgtgcaccaccatgcctggctaattttttttattttttgtagagacagggtttcactatgtggcccaagctagtctcaaattcctgggctcaagcgatcctcctgcctcagcctcccaagtaacctggattgcaggcacatgccgccacacccagctagttcttgcaattattattattaaggactgtttatccttaggcatcctttctcctcatgtggactttggcctttccgtgacatttggcatctttcatgaatcttctgaaaagcttcaggttaatgtgagctgctttggtatcttaacaccaaaggtgtcattggggtcattgccagtgtccagcatcaacaattcagacaagcaccaaaactgcttgaaacctgcatgttaactatgtggaaaggaagacaaacagtctaagataaaaagaaacgcatgtaaggaccatgcctttttttaatagctaaggaaaatattttaatatttttaatttaataaattttaatttaatattaaaattaaaattttaatttaatattaaattaaaattttaattttaaataaataattaaaatttaaataaatttaaatttaaaatttaaatttaattttaaataaacatttaaatttttaattttaatattaaattaatttaatttaatattaatttaacttaatttaatttaatattaatttaacttaatttaattaatttaatattaaattaaattttaatatttttaattttaatattaatttaatttaatttaatttaatattaattaatttaattttaattttaattgcttcaatattaaattaaattttaatatttttattttaatattaaattaaaattttaatttaaaattaaatatttaatattaaattaatttaaatttaatattaaattttaatagctaaggaaaatattttaatattaaaaaaagaccatggccttttttcaatagctaaggaaaagcaggagaagaggggcccaacagtgcttaagtaggggtggagaaagatttgcttaaacaggtagctgaatatagctcttctagttctgacagaaagtattctccccatccatcccctaaagaaacccccaactgtgaaacaactaaaagatggagatgcagctttgatcataagcagagaggctagtttaagaggatgtgaatgacagaggaggtagcaaagaaaatcagaaagggctgattcataaggcacctatactcaaggtagaaacaatgaagcagacagctactattccaggactcttatgtgtaatagacactctccaacatcacttaggtgagcatcaccacagcccctgagataagagagtctattgctgccccctgttgacaaatgaagagattgcagattaaaaggttattaacttggccaagtctcaaatgaggagtaaagtgtaggttaaaatcctggtcagtctggctccagggcccaactcacagggaagttggagagcacaagagtgagtgatcagaacagcaggagatcagcctgtaaaggaaagcatcaagaggagaaggygccatgctgggtgccaggccctaccaggaaggacccaagcatggcctccaccagtcacgccctccaatctcctcctctccagttcctgatcccccatatccgctacaccatggaaatcaacacccgggcccggacccaactcatctcagatggaggaatttttgataaggtgaggagggtacggggcatgggactgcctcatccatctctccatgatctgccactttcaggatccaagatcaactatgtgtgaatgtyctcactcttaacctatgaacctgtcccttttatacccatgtctttttttttttttttttttttttgagacagagtctagctctgtcgcccaggttggagtgcagtggcgccatctcggctcactgccatctccgcctcctgggttcaagcgattctcctgcctcagcctcccgagtagctgggattacaggcgcccgccaccatgcccagctaatttttatatttttagtagagatggggtttcactgtgttggccagactggtctcgaactcctgacctcatgatccacccacctcagcctcccaaagtgctgtatacccatgtcttaatatctgaaaatcccacatttgccccactttatggaagatgtgttggttctccagccctgtttccccctctaagacctgtgatctcctgtcccaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtgagtaaggaggagctgagaaatggtggggcggggggggagactgggggaggtgtctggaaaaatcaggattttctgacgatgtatgacagcaaccatgcgaattcctagaactaaggacccacatcttcatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaragggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagcmctgcccttctggggacaggaccccagcctctyatcacgcctcycttcctccctccacacgggaaagcatgtgtatcccattccyacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatccttggggctcaggtttctttggctaatccaactcttccaccctaaccaccccttggccaaaatctagccactacctttagtcaactctcactccccacatttgaacctctgaggaagaaaaagcctttgctgagctcttaggtttaatcacacaggcaccagcctggactgctgtcactcatccttcggcccctccccctcacacttcagatctaggctgtgaataccatcctctgcctctgtgagacaactacagacatttactggggagcccttatggcgaatcctgggaatgtggcaaacctccttaccctggagggagcctctccctggggaatctgcaccaccctacccttccaggaccaaactctctctagttcttctcagtacagtcccttaggctcctagcagtttgggctactacaacaaaacactagctgggcacagtggctcacgcttgtaatcccagcactttgggaggctgaggtgggtggatcacgaggtcaggagttcgagaccagcctggccaacatagtgaaacccgtctctactaaaaatacaaaaattagccaggcgtcgtggcacgcacctgtaatcccagctactcgggaggctgaggcaggagaatcgcttgaacttgggaggcggaggttgcagtgagctgagatcacgccattgcactccagcctgggcaacagagcgaaactccgtctcaaaaaaataaaataaaaaaaaccacacaccatagactgggtggcttataaacaacagaaatgtattcctcacagttctggaggctgaaagttcaagatcaggttctggtgagacccctcttccaggctgcccacagccgatttctccctgtatcctcacacagcagaaagatagcaagctagcactctgtcctctgctcataaaggtatcaaacccattcaggagggctgcaccctcacaccctaattatcatgtggggctccacctccaaataccatcacaataggattagatttcaatataaaaatttttcggagccaaagacattcagttcatgacacatgttaactttaacctccactaaccaccctcccccctgttctctttcagttctcatagctcacttttgtctagttttcccagcagacattttagaggctaaaattaaaaatgccatgggattagcagtcaggaacctgagttcaagatcarcctctgccttttcccaactatgcagtcctgacagtttattctctatgggctttgattttcttacctataaaatgagagtaattatatttattccacttaactgataagattattgggtctcccagcactttaggaggccaaggtgggcagatcacctgaggccaggagttccagaccagcctagccaacacggtgaaactccatctctactaaaaatacaaaaattagctgggcatggtggtgggagcctgtaatcccagctacttgggaggctgaggcaggagaatcacttgaacctgagaggcggaggttacagtgagccgagattgtgccactgcactccagcctgggcaacagagcaagactccgtctcaaaaaaaaaaaaaagattatcgggtctctgagcccccatatccactgcaaaatgagtggactgagataacctttgtgggagcccctctcagctgtgacactggaaatccatgacttattccccacattataacgcagacacttgtaattctgtccgggaataggattacgcattcctaaattatttatttattttttaatttttaaatagagacaggctcttgctctgtcacctgactaccagcaatcctcctgccttggcctcccaaagtgctgggattacaggcatgagtcaccgaccacgcatccctcaattggtttttttttttttgagacagactctcgttgtgtcgcccaggctggagtgcagtggcgggatctcagctcgctgcaagctctgcctcccgggttcacgccattctcctgcctcagcctcccgagtacctgggactacaggtgcccgccaccacacctggctaacttttcgtatttttagtagagacggggtttcaccgtgttagccaggatggtctcgatctcctgacctcgtgatccgcccatcttggcctccccaagtgctgggactacaggcgtgagccaccgcgcccggccgcatccctcaattcttaaccactttttgaggcaagggatatttggtcactcagaacttttcagcccccaatccttccataacaataattattacttacttattgagcatttattacagaccaggtgattttgatacatcatctcatttataatgtaggtatcgtccatattttacaggtgaaaaaaactgaggttcaaataggttaagctggcctatggtaactaagtgtaagtgactgagccaggacttaaacgcatgtctgatgcaaatacgtctaaataaaataaayaaattcatcaattctaaaatatgggcatcccaaaacaacagcctttgttcctctcctcttatgctgtagcttctaactgctattcctttcytgcccaggtttccctgtctccttccagtcccagagtcaactctgccatttcctcaccatgtgcgtcttcacgtgcactgcccagcatgccgccatcaaccagggccaggtatggacagctgaaagcccaggtcatgaaggcaaggtgacctgagggagagatgggagttcaaaccctaagtaccagggttctagggttacagtttcttcctccagctggactggtatgcctgggtccctaatgctccatgcacaatgcggatgcccccacccaccamcaaggaagatgtgacgawggccacagtgatggggtcactacctgatgtccggcaggcctgtcttcaaatggccatctcatggcatctgagtcgccgccagccagacatggtgagaggggactctcrggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctrgaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctccccyagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaacaaatgtgctttgtttgagacatgcacagccaggctacagactggatttggcccttgaaccctgyactagcctgaggccctgaccctacttccaaaacatccaagatcatggagcagggggatttcttagaaaaatcagcttacctcagctaactctccattcccaggaactaaccttcatgcctggtggccaatgtacaaattcctgactcagttctttggcaaattccttccacccatatttctcctattcacccatgtaccccaaaagtccctgaataagaatcatgtttttggggcagaatacaaaccactgccccaaaatggcttctttctccaaacagtcccagatgaaaggcacataattcatgtcttaaggctacttttccagcccctttaatactctgggatctatgtgtttcccacattccaagttatctttcacaagccttttaagaacaacatgcacaaaataaatggacaagaactacaaagttattctagccaatgatagtgtttatttgttaggtcctggggtctcaaggtcaaatgatccctctcaattattctgaggtcactgtcctcactagagtgggtacaacttgctcactgcaaaactgtgttcttcaaacatccctacttcttttcttttctttttttttttttttttttagaagtagtctctatcgcccaggcgggaatgcagtggcgccatctcagctcactgcaaccttcgcctcccgggttcaagggattatcccgcctcaccatcccgagtggctgggatcacaagctcatgccaccacatccagctaatttttgtaatttttagtagagacagggtttcgccatgttgacctggctggtctcgaactcccgacctcaggtgatccgcccgcctcgacattcctatttctaaataattattacagatctgtcactcaccagttaaacatacaaacggcttttttggaggggatgacctatttatatttttaaatcttatatcctaccttattcaaaagtcctatcagttttcctagtttagagaagcaaagtgacatttttgtgtacatttaacaggactgcttaccttcacaacctgctcagtcggctttccctggacttctcctaaccgcccatttttcctggatttggcaccgagagttacagtatttcacgtgcgatgataaaatgttacttaggagaaacagttccaataccaagaaacttcagcaattttaaagcattttaaagccacaaaaccatgcccgatccccaaaagggggtcctaactcctttacactgtcagaatctcaattttaaaagggaggagtagagaagagatagaaacgctctctgttggtgaaaatctgtcttacttaccatttccccaacacaggagagactaaggaatttcaggtaaaaatcagatggctccaatcctccgatactaagagcccatcgccccagttcccaggagttccgccagttagactttttcccccatggcctcgctaaggctagttcctcgtcacgtgacgtgacaggcttggtcacgtgacataccagctccttccattcccgtgtgcggggggagggggaccaacaaaccggaggccctcgctcttccaatactcacgccctagctacagaggtcaaggaaggtttccccaggagcagttttggtttcagacggcgccgtctcccgcgaaagtcctgagaggagcccagccttttccgcctgccgcccccggatgggatggttgaggccggggccacgccccctctgcccccctgcgagggcatccttggctttctcccaccgctttccgagcccgcttgcacctcggcgatccccgactcccttctttatggcgtcgctcctgtgctgtgggccgaagctggcccctgcggcatcgtcctcagcgcctggggagtgatcatgttggtgaggggactccccggcaaggatcggagagggcctgaggggctccgggctgggagggctgggaggcgaggaaactctgggccgcaggcaggccggaggggccggggatctacaggccccggagaaggagacagactgaaattgaaaaatgggaactgttcgagaccagcctgaccaacatggtgaaaccccgtctccaataaaaatacaaaaattagccgggcgtggtggcgcccgcctgtaatcccagctactcaggaggctgaggcaggagaatcgcttgaatccgggaggcggagggtgcagtgagccgagatcgcgccactgcactccagcctgggtgacagagcgagactccgtccccaaagaaaaagaaaaaagggaactggagcggagggccctggagtgggaggagccagggctggtaaaggtggagacccctcaaggtaggagaaacaagagcggggttcctgagaggtgcttgagttgaatggaggacatgggaggaaaagagagtgcttgttccagaaatgtgtagctgggccttgttttcccagtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccaggtggctgagtccgaatccagtaaccaccacctcgttttggttaatctcaggctcgggtgttgtagcaacattggaaatgggaggggtttacgaagtgaacatgaggtcaggtgcctgaattcaacagtctacccattccccttttccagataatgctcggaatatttttcaatgtccattccgctgtgttgattgaggacgttcccttcacggagaaagattttgagtaagtattcgggtgggggaggcgggctgggagcaggtgggaggtggcgaggcctagggtcagaattacgtctgggaggcccggtgcttagggcccctaggttagaggactt

SEQ ID NO: 652 - DNA, 2343 bp, Homo sapiens
  5'UTR 1..39
  CDS 40..2031
  3'UTR 2032..2343
  allele 366: 10-343-231  : deletion of C
  allele 605: 10-346-141  : polymorphic base A or G
  allele 712: 10-347-111  : polymorphic base G or C
  allele 766: 10-347-165  : polymorphic base C or T
  allele 804: 10-347-203  : polymorphic base A or G
  allele 821: 10-347-220  : polymorphic base A or G
  allele 1004: 10-349-97  : polymorphic base A or G
  allele 1049: 10-349-142  : polymorphic base G or C
  allele 1123: 10-349-216  : deletion of CTG
  allele 1131: 10-349-224  : polymorphic base G or T
  allele 1491: 10-507-170  : polymorphic base A or G
  allele 1742: 10-340-112  : polymorphic base A or C
  allele 1760: 10-340-130  : polymorphic base A or T
  allele 1941: 10-341-116  : polymorphic base A or G
  allele 2144: 10-341-319  : polymorphic base C or T
aggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccgcccgcctgccaggagacaatgctttggacatgttccagaagcatcgagagaaggaactgaaagacagacagcagatctactgctgggccacctggaaggaagggttacccctgaccatcgctgcagaccgtaaggatgatctacctccaaatatgagattccatgaggagaagaggctggactttgaatggacactgaaggcaggggctctggagatggccctcaaacrtgtttacaccctcctgagctcctggaactgcctagaagactttgatcagatcttctggggccagaagagtgccctggctgagaaggttcgccagtgctggcaggatsatgagttgttcagctaccagttcctcaatggtgccaaccccatgctgttgagaygctcgacctctctgccctccaggctagtgctgccctcrgggatggaagagcttcrggctcaactggagaaagaacttcagaatggttccctgtttgaagctgacttcatccttctggatggaattccagccaacgtgatccgaggagagaagcaatacctggctgcccccctcgttatgctgaagatggagcccaatgggaagctgcagcccatggtcatccagattcagcctcccarccccagctctccaaccccaacactgttcctgccctcagacccccsacttgcctggctcctggcaaagtcctgggtccgaaattcagatttccaactgcacgagatccagtatcacttgctgaacackcacctggtggctgaggtcatcgctgtcgccaccatgcggtgcctcccaggactgcaccccatcttcaagttcctgatcccccatatccgctacaccatggaaatcaacacccgggcccggacccaactcatctcagatggaggaatttttgataaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtatgtggaggggatcgtccacctcttctaccaragggatgacatagtgaagggggaccctgagctgcaggcctggtgtcgggagatcacggaggtggggctgtgccaggcccaggaccgaggtttccctgtctccttccagtcccagagtcaactctgccatttcctcaccatgtgcgtcttcacgtgcactgcccagcatgccgccatcaaccagggccagctggactggtatgcctgggtccctaatgctccatgcacaatgcggatgcccccacccaccamcaaggaagatgtgacgawggccacagtgatggggtcactacctgatgtccggcaggcctgtcttcaaatggccatctcatggcatctgagtcgccgccagccagacatggtgcctctggggcaccacaaagaaaaatatttctcaggccccaagcccaaagctgtgctaaaccaattccgaacagatttggaaaagctrgaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctccccyagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactg

SEQ ID NO: 653 - protein, 663 aa, Homo sapiens
  VARIANT 189: Xaa=Arg or His
  VARIANT 225: Xaa=Asp or His
  VARIANT 243: Xaa=Arg or Cys
  VARIANT 261: Xaa=Gln or Arg
  VARIANT 322: Xaa=Ser or Asn
  VARIANT 337: Xaa=Pro or Arg
  VARIANT 362: deletion of Leu
  VARIANT 568: Xaa=Asn or Thr
  VARIANT 574: Xaa=Met or Lys
MGRYRIRVATGAWLFSGSYNRVQLWLVGTRGEAELELQLRPARGEEEEFDHDVAEDLGLLQFVRLRKHHWLVDDAWFCDRITVQGPGACAEVAFPCYRWVQGEDILSLPEGTARLPGDNALDMFQKHREKELKDRQQIYCWATWKEGLPLTIAADRKDDLPPNMRFHEEKRLDFEWTLKAGALEMALKXVYTLLSSWNCLEDFDQIFWGQKSALAEKVRQCWQDXELFSYQFLNGANPMLLRXSTSLPSRLVLPSGMEELXAQLEKELQNGSLFEADFILLDGIPANVIRGEKQYLAAPLVMLKMEPNGKLQPMVIQIQPPXPSSPTPTLFLPSDPXLAWLLAKSWVRNSDFQLHEIQYHLLNTHLVAEVIAVATMRCLPGLHPIFKFLIPHIRYTMEINTRARTQLISDGGIFDKAVSTGGGGHVQLLRRAAAQLTYCSLCPPDDLADRGLLGLPGALYAHDALRLWEIIARYVEGIVHLFYQRDDIVKGDPELQAWCREITEVGLCQAQDRGFPVSFQSQSQLCHFLTMCVFTCTAQHAAINQGQLDWYAWVPNAPCTMRMPPPTXKEDVTXATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 654 - protein, 131 aa, Homo sapiens
MGRYRIRVATGAWLFSGSYNRVQLWLVGTRGEAELELQLRPARGEEEEFDHDVAEDLGLLQFVRLRKHHWLVDDAWFCDRITVQGPGACAEVAFPCYRWVQGEDILSLPRAPPACQETMLWTCSRSIERRN

SEQ ID NO: 655 - DNA, 47 bp, Homo Sapiens
  allele 24: 10-253-118 : polymorphic base A or G
tccacggagcccggaaggtttccrgtgatggtgggggctgaccacgt

SEQ ID NO: 656 - DNA, 47 bp, Homo Sapiens
  allele 24: 10-253-298 : polymorphic base G or C
tgcaagagtgaatacacttctcastccctcctcccaatttytatttg

SEQ ID NO: 657 - DNA, 47 bp, Homo Sapiens
  allele 24: 10-253-315 : polymorphic base C or T
  misc_feature 36: n=a, g, c or t
ttctcactccctcctcccaatttytatttgcgggantagtcagtccc

SEQ ID NO: 658 - DNA, 47 bp, Homo Sapiens
  allele 24: 10-499-155 : polymorphic base A or G
gagaagctgagagagagcgagagragagattggaagaaagacagaga

SEQ ID NO: 659 - DNA, 47 bp, Homo Sapiens
  allele 24: 10-520-256 : polymorphic base C or T
aggtcaggagatcgagaccatccyggctaacacggtgaaacccccgt

SEQ ID NO: 660 - DNA, 47 bp, Homo Sapiens
  allele 24: 10-500-258 : polymorphic base G or T
  misc_feature 1: n=a, g, c or t
ngccaggcgtggtggtgggtgcckgtagtcccagctactgaggaggc

SEQ ID NO: 661 - DNA, 47 bp, Homo Sapiens
  allele 24: 10-500-410 : polymorphic base A or G
aaaaaaaaaaaatagagaggaagrgcgggagagagagagagagaaag

SEQ ID NO: 662 - DNA, 47 bp, Homo Sapiens
  allele 24: 10-503-159 : polymorphic base G or T
actctacaaagtgccctaggtackcagggagtacccaagtgtgtcat

SEQ ID NO: 663 - DNA, 47 bp, Homo Sapiens
  allele 24: 10-504-172 : polymorphic base A or T
attgcaggtattttgcattttccwtgtaacctcagagggattgccat

SEQ ID NO: 664 - DNA, 47 bp, Homo Sapiens
  allele 24: 10-504-243 : polymorphic base A or C
taccaggcagccacctcacccacmcagcaggtccactcttatacttt

SEQ ID NO: 665 - DNA, 47 bp, Homo Sapiens
  allele 24: 10-204-326 : polymorphic base A or G
tctctggtgcctgtgctgggctcrtgctggtcatggtcttgggtcca

SEQ ID NO: 666 - DNA, 47 bp, Homo Sapiens
  allele 24: 10-32-357 : polymorphic base A or C
agaatggtaaggaaagcccttcamtcagggaagaacagaaggggaga

SEQ ID NO: 667 - DNA, 47 bp, Homo Sapiens
  allele 24: 10-33-175 : polymorphic base C or T
agcaggacccagaatgggaggagyttccagaggaccggaacacttgc

SEQ ID NO: 668 - DNA, 47 bp, Homo Sapiens
  allele 24: 10-33-211 : polymorphic base C or T
ggaacacttgcctttgagcgggtytacactgccaagtgagtcctaav

SEQ ID NO: 669 - DNA, 47 bp, Homo Sapiens
  allele 24: 10-33-234 : polymorphic base A or C
ctacactgccaagtgagtcctaamcctgatgttgctaataagtgggg

SEQ ID NO: 670 - DNA, 47 bp, Homo Sapiens
  allele 24: 10-33-270 : polymorphic base A or G
aataagtgggggcatgggcagggrggcctccttctaggagtgatgac

SEQ ID NO: 671 - DNA, 47 bp, Homo Sapiens
  allele 24: 10-33-327 : polymorphic base C or T
accacatgtctgtctgagccaagyttctgagcgccagggaggtgagg

SEQ ID NO: 672 - DNA, 47 bp, Homo Sapiens
  allele 24: 10-34-290 : polymorphic base G or T
tgcatctcaaggaggttcaaaggkcaggctttttgttgaaaggactt

SEQ ID NO: 673 - DNA, 47 bp, Homo Sapiens
  allele 24: 10-35-358 : polymorphic base G or C
cgtagcatccccttgggtgggagsgggaaggctgactaggacctctg

SEQ ID NO: 674 - DNA, 47 bp, Homo Sapiens
  allele 24: 10-35-390 : polymorphic base C or T
tgactaggacctctgattcttctytccctgagctttgaaggctctga

SEQ ID NO: 675 - DNA, 47 bp, Homo Sapiens
  allele 24: 10-36-164 : polymorphic base A or G
tactcttcctgttcctcatgtccrttgctggcatattcaactattac

SEQ ID NO: 676 - DNA, 47 bp, Homo Sapiens
  allele 24: 10-498-192 : polymorphic base A or G
gtggccccaaatttgctattcccrtgcattttgtttgtttcttcact

SEQ ID NO: 677 - DNA, 47 bp, Homo Sapiens
  allele 24: 12-628-306 : polymorphic base G or A
tgtgcctacttacctatacgaccrtgtggtggggtttatggtgggtg

SEQ ID NO: 678 - DNA, 47 bp, Homo Sapiens
  allele 24: 12-628-311 : polymorphic base T or C
gtaattgtgcctacttacctataygaccgtgtggtggggtttatggt

SEQ ID NO: 679 - DNA, 47 bp, Homo Sapiens
  allele 24: 12-629-241 : polymorphic base G or C
tggggccagagtgcatgtctaagscattaaggggaggggagagcagc

SEQ ID NO: 680 - DNA, 47 bp, Homo Sapiens
  allele 24: 12-206-366 : polymorphic base C or T
gggcaccggtgagcaggcggcgtyggggaaggaggcacaaggtcccg

SEQ ID NO: 681 - DNA, 47 bp, Homo Sapiens
  allele 24: 10-343-339 : polymorphic base G or T
acggtcggagcagacttagaggakgtatgggcccagggcaggtgaaa

SEQ ID NO: 682 - DNA, 47 bp, Homo Sapiens
  allele 24: 10-347-74 : polymorphic base A or G
ggtacatatatcctcctttcaccrcccaccaaagagaaggttcgcca

SEQ ID NO: 683 - DNA, 47 bp, Homo Sapiens
  allele 24: 10-347-111 : polymorphic base G or C
aggttcgccagtgctggcaggatsatgagttgttcagctaccagttc

SEQ ID NO: 684 - DNA, 47 bp, Homo Sapiens
  allele 24: 10-347-165 : polymorphic base C or T
gtgccaaccccatgctgttgagaygctcgacctctctgccctccagg

SEQ ID NO: 685 - DNA, 47 bp, Homo Sapiens
  allele 24: 10-347-203 : polymorphic base A or G
ccctccaggctagtgctgccctcrgggatggaagagcttcrggctca

SEQ ID NO: 686 - DNA, 47 bp, Homo Sapiens
  allele 24: 10-347-220 : polymorphic base A or G
gccctcrgggatggaagagcttcrggctcaactggagaaagaacttc

SEQ ID NO: 687 - DNA, 47 bp, Homo Sapiens
  allele 24: 10-347-271 : polymorphic base A or T
tacctctccttcccctgcctggcwctgttctctccttagtagtgtgg

SEQ ID NO: 688 - DNA, 47 bp, Homo Sapiens
  allele 24: 10-347-348 : polymorphic base A or G
tcagaggaaggctgcagtactgcrttgccccttggtgcagtcctgtg

SEQ ID NO: 689 - DNA, 47 bp, Homo Sapiens
  allele 24: 10-348-391 : polymorphic base A or G
tgtcactatttgcctgtaccctcrtctcccctgctcatccaactaga

SEQ ID NO: 690 - DNA, 47 bp, Homo Sapiens
  allele 24: 10-349-47 : polymorphic base C or T
agaatgctgactataatgtcatayacggaatgggagttcaataattt

SEQ ID NO: 691 - DNA, 47 bp, Homo Sapiens
  allele 24: 10-349-97 : polymorphic base A or G
tttctcccagattcagcctcccarccccagctctccaaccccaacac

SEQ ID NO: 692 - DNA, 47 bp, Homo Sapiens
  allele 24: 10-349-142 : polymorphic base G or C
actgttcctgccctcagacccccsacttgcctggctcctggcaaagt

SEQ ID NO: 693 - DNA, 47 bp, Homo Sapiens
  allele 24: 10-349-224 : polymorphic base G or T
atccagtatcacttgctgaacackcacctggtggctgaggtcatcgc

SEQ ID NO: 694 - DNA, 47 bp, Homo Sapiens
  allele 24: 10-349-368 : polymorphic base C or T
gaacagccccatatcaaaagataytgcagcagcaaaaactctttgta

SEQ ID NO: 695 - DNA, 47 bp, Homo Sapiens
  allele 24: 10-339-32 : polymorphic base C or T
caaatacgtctaaataaaataaayaaattcatcaattctaaaatatg

SEQ ID NO: 696 - DNA, 47 bp, Homo Sapiens
  allele 24: 10-341-116 : polymorphic base A or G
ttccgaacagatttggaaaagctrgaaaaggagattacagcccggaa

SEQ ID NO: 697 - DNA, 47 bp, Homo Sapiens
  allele 24: 10-341-319 : polymorphic base C or T
tgctaaggctctatttcctccccyagttaaaccccctacattagtat

SEQ ID NO: 698 - DNA, 47 bp, Homo Sapiens
  allele 24: 12-196-119 : polymorphic base C or T
gccttgttggctgttattaaggayttgtttttactctgagtcagaga

SEQ ID NO: 699 - DNA, 47 bp, Homo Sapiens
  allele 24: 12-197-244 : polymorphic base C or T
cagccgcctcctcagtaaagttgytttcttccagcactggcttgctc

SEQ ID NO: 700 - DNA, 47 bp, Homo Sapiens
  allele 24: 12-198-128 : polymorphic base A or G
cagcgctcccaactctgagtgacrtcccacctctggtccttgcagca

SEQ ID NO: 701 - DNA, 47 bp, Homo Sapiens
  allele 24: 12-206-81 : polymorphic base A or G
aaactgaggttgcacaggagcgcrgctctgtcctcgaaacggcctca

SEQ ID NO: 702 - DNA, 47 bp, Homo Sapiens
  allele 24: 12-208-35 : polymorphic base A or T
ctattattcctagtttcatttcawtgtgattggaaaagatatttcat

SEQ ID NO: 703 - DNA, 47 bp, Homo Sapiens
  allele 24: 12-214-129 : polymorphic base C or T
tccactgaagggacctgctgcccygtcaactgggtggagcaccaaga

SEQ ID NO: 704 - DNA, 47 bp, Homo Sapiens
  allele 24: 12-214-151 : polymorphic base G or C
ctgtcaactgggtggagcaccaasacagctgctactggttctctcac

SEQ ID NO: 705 - DNA, 47 bp, Homo Sapiens
  allele 24: 12-214-360 : polymorphic base G or C
aatcatctgggagcttccagaatsactgtcatctgtgccacaccctc

SEQ ID NO: 706 - DNA, 47 bp, Homo Sapiens
  allele 24: 12-215-467 : polymorphic base G or T
attttgataatattgatttttcckattcatggacatgggattttgtg

SEQ ID NO: 707 - DNA, 47 bp, Homo Sapiens
  allele 24: 12-216-421 : polymorphic base A or G
cttaaagatggtataaacttaggrtgattaggaaaagccattgttta

SEQ ID NO: 708 - DNA, 47 bp, Homo Sapiens
  allele 24: 12-219-230 : polymorphic base A or G
ttgttttcactgtgggggtgaccrttatagcatgatcttattcattt

SEQ ID NO: 709 - DNA, 47 bp, Homo Sapiens
  allele 24: 12-219-256 : polymorphic base C or T
atagcatgatcttattcatttatytgatggcttttaatttaaatcat

SEQ ID NO: 710 - DNA, 47 bp, Homo Sapiens
  allele 24: 12-220-48 : polymorphic base G or A
tcaggaacctgagttcaagatcarcctctgccttttcccaactatgc

SEQ ID NO: 711 - DNA, 47 bp, Homo Sapiens
  allele 24: 12-221-302 : polymorphic base A or C
agttcacaacatccaatcagagcmaatactgaggtagaggcaggtct

SEQ ID NO: 712 - DNA, 47 bp, Homo Sapiens
  allele 24: 12-223-179 : polymorphic base A or G
tcaagctttggctttctgggcctractctgtggagttcagtcctctt

SEQ ID NO: 713 - DNA, 47 bp, Homo Sapiens
  allele 24: 12-223-207 : polymorphic base C or T
tgtggagttcagtcctcttccagyccctccttgggtaggggaacttt

SEQ ID NO: 714 - DNA, 47 bp, Homo Sapiens
  allele 24: 12-225-541 : polymorphic base C or T
ctgaccccaatcctagcatgagayacaacctccagtcctgcctgatt

SEQ ID NO: 715 - DNA, 47 bp, Homo Sapiens
  allele 24: 12-226-167 : polymorphic base G or C
gtaacatgtaaaatcggtgacatsaagattccactgatgtgtgattc

SEQ ID NO: 716 - DNA, 47 bp, Homo Sapiens
  allele 24: 12-226-458 : polymorphic base C or T
acggctaagtaaaatatttcaagyagtagctggatctcagtctcctg

SEQ ID NO: 717 - DNA, 47 bp, Homo Sapiens
  allele 24: 12-229-332 : polymorphic base G or C
tgtgtgtgtttggtggtccccacsggtgtgaggggcctgtgtgactg

SEQ ID NO: 718 - DNA, 47 bp, Homo Sapiens
  allele 24: 12-229-351 : polymorphic base G or C
ccacgggtgtgaggggcctgtgtsactgaggacttgtgctggtccct

SEQ ID NO: 719 - DNA, 47 bp, Homo Sapiens
  allele 24: 12-230-364 : polymorphic base C or T
tccctttgtctgccttcccagccycagcctgagacctgggcatctga

SEQ ID NO: 720 - DNA, 47 bp, Homo Sapiens
  allele 24: 12-231-100 : polymorphic base C or T
atgacacccgtccctcacaaatgygttttaaaccagaatcggtctca

SEQ ID NO: 721 - DNA, 47 bp, Homo Sapiens
  allele 24: 12-231-148 : polymorphic base C or T
tgcaagggactcctgattgtgaayggaggagagaaagataggatgaa

SEQ ID NO: 722 - DNA, 47 bp, Homo Sapiens
  allele 24: 12-231-266 : polymorphic base C or T
gagatgctgcccagcatttaaaaygttttgacagtaggggagaggca

SEQ ID NO: 723 - DNA, 46 bp, Homo Sapiens
  allele 23: 10-231-23 : polymorphic base A or G
agtgatgtgtgataacccattcrtatacacagggaactcaacctat

SEQ ID NO: 724 - DNA, 47 bp, Homo Sapiens
  allele 24: 10-233-386 : polymorphic base A or G
agttagactgggcagcttggtagrctagaatctaaatggtgtctgtc

SEQ ID NO: 725 - DNA, 47 bp, Homo Sapiens
  allele 24: 10-238-328 : polymorphic base C or T
tgtaagttacagttcaatctacaytgcttttataacaagtagacaga

SEQ ID NO: 726 - DNA, 47 bp, Homo Sapiens
  allele 24: 10-239-368 : polymorphic base C or T
ctctacttatttgtccaactatgygtactgagcccattctccccacc

SEQ ID NO: 727 - DNA, 47 bp, Homo Sapiens
  allele 24: 10-223-30 : polymorphic base G or C
gaaatctgagaacatgattaaatstaataaatctagaattattaaat

SEQ ID NO: 728 - DNA, 47 bp, Homo Sapiens
  allele 24: 10-223-72 : polymorphic base A or G
ttaaatggatttaaatttatactrgtagagctagtagatctcactct

SEQ ID NO: 729 - DNA, 47 bp, Homo Sapiens
  allele 24: 10-223-130 : polymorphic base A or T
tcagattacttttttatattaaawttaattgttaattttgacacctg

SEQ ID NO: 730 - DNA, 47 bp, Homo Sapiens
  allele 24: 10-223-262 : polymorphic base A or G
atgaatcacacgaacccaaaggtragtgagccggaaacttttctggc

SEQ ID NO: 731 - DNA, 47 bp, Homo Sapiens
  allele 24: 10-223-392 : polymorphic base A or G
aagtgataaaattgtagctttctrttgagagagaggattgcatgttg

SEQ ID NO: 732 - DNA, 47 bp, Homo Sapiens
  allele 24: 10-224-341 : polymorphic base C or T
tctctggagagaagcattttaatyattattaacacttactcatttat

SEQ ID NO: 733 - DNA, 47 bp, Homo Sapiens
  allele 24: 10-227-282 : polymorphic base A or G
caacatcaacttcagaaagtacarggctccaggtaagtagggagtaa

SEQ ID NO: 734 - DNA, 47 bp, Homo Sapiens
  allele 24: 10-240-241 : polymorphic base A or G
ttctttgcaagaaggtagagataraggtaagtcttggttttcctttt

SEQ ID NO: 735 - DNA, 47 bp, Homo Sapiens
  allele 24: 10-249-185 : polymorphic base A or G
ggtcaccttgaggaggttgttttrgctctgctaaaaactccagcgca

SEQ ID NO: 736 - DNA, 47 bp, Homo Sapiens
  allele 24: 10-251-128 : polymorphic base A or G
ttacatgctagagaagagcttacratagaatgggatttctttcaggg

SEQ ID NO: 737 - DNA, 47 bp, Homo Sapiens
  allele 24: 10-252-209 : polymorphic base A or G
gccttgtatgaagcaggagaaagragaaaggggacagacgtaaacgt

SEQ ID NO: 738 - DNA, 47 bp, Homo Sapiens
  allele 24: 12-387-32 : polymorphic base A or G
cttatatgtcctgcttagaggaaraattatttgtagaaagaacagaa

SEQ ID NO: 739 - DNA, 47 bp, Homo Sapiens
  allele 24: 10-242-316 : polymorphic base G or C
aaaacctcatgttgtttgaaaatstcacatttaatatcttcccatta

SEQ ID NO: 740 - DNA, 47 bp, Homo Sapiens
  allele 24: 10-245-412 : polymorphic base A or G
atagagttcacattctgaattgargaaaatacttatagyttttgaaa

SEQ ID NO: 741 - DNA, 47 bp, Homo Sapiens
  allele 24: 12-378-171 : polymorphic base T or C
ttgtaacaaaggaagggtagcagygcaaagacaagagagagggaaaa

SEQ ID NO: 742 - DNA, 47 bp, Homo Sapiens
  allele 24: 12-378-228 : polymorphic base G or A
atacctgtcagctgaaatccaccrgattgattttcactgctcagagc

SEQ ID NO: 743 - DNA, 47 bp, Homo Sapiens
  allele 24: 12-378-450 : polymorphic base T or A
accagagtcatgctataaagtgasaataataagatatttctttctta

SEQ ID NO: 744 - DNA, 47 bp, Homo Sapiens
  allele 24: 12-379-65 : polymorphic base A or G
gaaaattatgaaaaagagttcaaraataatcaaccctgagaaaagat

SEQ ID NO: 745 - DNA, 47 bp, Homo Sapiens
  allele 24: 12-382-204 : polymorphic base A or G
catttaacagatgttgacaaaatrgttaataataatattattaagga

SEQ ID NO: 746 - DNA, 47 bp, Homo Sapiens
  allele 24: 12-383-117 : polymorphic base A or G
taggaagcgctttggtaaatcaaragagagtaatggattcaggaaag

SEQ ID NO: 747 - DNA, 47 bp, Homo Sapiens
  allele 24: 12-383-170 : polymorphic base A or G
aaacagcaaaaacctgaatggctrgtggcatttcatattcctgaatg

SEQ ID NO: 748 - DNA, 47 bp, Homo Sapiens
  allele 24: 12-383-268 : polymorphic base G or T
gcatttttacaaaaatattattckgttttcaaataaacctgggaggg

SEQ ID NO: 749 - DNA, 47 bp, Homo Sapiens
  allele 24: 12-384-336 : polymorphic base T or C
atataccttccgaaagtgctgaayttacttactttatcaaaactact

SEQ ID NO: 750 - DNA, 47 bp, Homo Sapiens
  allele 24: 12-384-451 : polymorphic base C or G
ggtctcttaacttgcctacacctwtaaggaagtacacctcagtattc

SEQ ID NO: 751 - DNA, 47 bp, Homo Sapiens
  allele 24: 12-385-123 : polymorphic base C or T
agacatagtcgagccgaattcccycaggcctaaccttctaattcttc

SEQ ID NO: 752 - DNA, 47 bp, Homo Sapiens
  allele 24: 12-385-427 : polymorphic base G or T
ttcatattaaacattattcatcakcactgaatgagaattgcaaaggc

SEQ ID NO: 753 - DNA, 47 bp, Homo Sapiens
  allele 24: 12-386-155 : polymorphic base G or T
ttatatcaaacaatgtaccaggckgggcacaccacagaggcaattca

SEQ ID NO: 754 - DNA, 47 bp, Homo Sapiens
  allele 24: 12-386-24 : polymorphic base C or T
cagaagtagtgcatctgtttcaaytgaagcaacgtaaaagattggca

SEQ ID NO: 755 - DNA, 47 bp, Homo Sapiens
  allele 24: 12-387-177 : polymorphic base C or T
taaacttctgttagattcggtgcytttttttacagatgagattgtaa

SEQ ID NO: 756 - DNA, 42 bp, Homo Sapiens
  allele 24: 12-389-431 : polymorphic base C or T
gtatttcattcaattagaaaaagygaaagtatgttgagctag

SEQ ID NO: 757 - DNA, 47 bp, Homo Sapiens
  allele 24: 12-391-366 : polymorphic base C or T
gcctacacttaactccatatcctyagctcctatggtcttctcaaacc

SEQ ID NO: 758 - DNA, 47 bp, Homo Sapiens
  allele 24: 12-394-85 : polymorphic base A or C
ggaaaccatttgcagaacacctgmtttctgtcctcacaattttagct

SEQ ID NO: 759 - DNA, 47 bp, Homo Sapiens
  allele 24: 12-395-382 : polymorphic base A or G
actgctgtgttttttctgattcarttttgcattgttataatacaatt

SEQ ID NO: 760 - DNA, 47 bp, Homo Sapiens
  allele 24: 12-400-217 : polymorphic base A or G
agtgagttctctactgaaatactrggtacatttttcaactaaagtca

SEQ ID NO: 761 - DNA, 47 bp, Homo Sapiens
  allele 24: 12-400-280 : polymorphic base A or G
cccatgcataaattcagcaagcaraatattctagtgttccccctagg

SEQ ID NO: 762 - DNA, 47 bp, Homo Sapiens
  allele 24: 12-401-378 : polymorphic base A or G
gtaatattgttttatgacattagrtttattttggggggttgtttctt

SEQ ID NO: 763 - DNA, 47 bp, Homo Sapiens
  allele 24: 12-402-126 : polymorphic base C or T
ttctctgagcctgtgttatatgaygggtggtattctagattcaagca

SEQ ID NO: 764 - DNA, 47 bp, Homo Sapiens
  allele 24: 12-404-265 : polymorphic base A or G
gggctgggctatatagcaagtagrctttactgaaggacagggtagag

SEQ ID NO: 765 - DNA, 47 bp, Homo Sapiens
  allele 24: 12-406-52 : polymorphic base C or T
tagaataattggctaatatcaaayattattaagacagtacgtcatca

SEQ ID NO: 766 - DNA, 47 bp, Homo Sapiens
  allele 24: 12-406-409 : polymorphic base A or G
ttatttttcactaaacagccctcrtgatgatttacccattatttcac

SEQ ID NO: 767 - DNA, 47 bp, Homo Sapiens
  allele 24: 12-407-217 : polymorphic base G or C
ggctgagagatggaaaaatgaagsggggggactctcttaggacacat

SEQ ID NO: 768 - DNA, 47 bp, Homo Sapiens
  allele 24: 12-407-399 : polymorphic base A or T
gatttgcctatgtataaatggccwatttcaccgtcaatgagctcatg

SEQ ID NO: 769 - DNA, 47 bp, Homo Sapiens
  allele 24: 12-408-355 : polymorphic base G or C
ttcctatggagagcacacactagstttaagtcctgagggtacttaag

SEQ ID NO: 770 - DNA, 47 bp, Homo Sapiens
  allele 24: 12-409-221 : polymorphic base A or C
aagcaagaattgttgaacaaaatmaaaatagtattaattttgaaatt

SEQ ID NO: 771 - DNA, 47 bp, Homo Sapiens
  allele 24: 12-410-301 : polymorphic base C or T
aacctctttttatattgcgtttaytatgtggaactgggaatctctga

SEQ ID NO: 772 - DNA, 47 bp, Homo Sapiens
  allele 24: 10-395-101 : polymorphic base A or G
aggagtagaaattagcataatgartcgctgtgcttcagagtaaagaa

SEQ ID NO: 773 - DNA, 47 bp, Homo Sapiens
  allele 24: 10-395-124 : polymorphic base A or G
agtcgctgtgcttcagagtaaagragagcctcttcataaagactttt

SEQ ID NO: 774 - DNA, 47 bp, Homo Sapiens
  allele 24: 10-395-155 : polymorphic base A or T
tcttcataaagactttttgttgtwctttttttccagcttccttcaaa

SEQ ID NO: 775 - DNA, 47 bp, Homo Sapiens
  allele 24: 10-395-294 : polymorphic base C or T
catctctctggataaccatattaytctctatccttgtacatctaagg

SEQ ID NO: 776 - DNA, 47 bp, Homo Sapiens
  allele 24: 10-396-100 : polymorphic base A or G
caacaagaggattttaaatgtgtrtcatttgagtatgtttatctttt

SEQ ID NO: 777 - DNA, 47 bp, Homo Sapiens
  allele 24: 10-397-201 : polymorphic base G or T
ccttatctggccacctggagacgktgattttgggcctattgaagaca

SEQ ID NO: 778 - DNA, 47 bp, Homo Sapiens
  allele 24: 10-399-178 : polymorphic base A or G
acaggcagaaagcataaaaccagrtgtattttcctccaagtgtacaa

SEQ ID NO: 779 - DNA, 47 bp, Homo Sapiens
  allele 24: 10-400-369 : polymorphic base A or T
ttctgtctccgcttggcactctcwtaggctcacccattttccctcac

SEQ ID NO: 780 - DNA, 43 bp, Homo Sapiens
  allele 20: 10-392-20 : polymorphic base A or G
aatgttggctctggtcaccrtggtaacctctaagctcctagga

SEQ ID NO: 781 - DNA, 47 bp, Homo Sapiens
  allele 24: 10-392-103 : polymorphic base A or G
tgcataaaactaggtgggtgatcrttgacagctttgactagtggctc

SEQ ID NO: 782 - DNA, 47 bp, Homo Sapiens
  allele 24: 10-392-324 : polymorphic base G or C
cagaagtgacagatggccatcctsttaatccaaatgtgtttgggagg

SEQ ID NO: 783 - DNA, 47 bp, Homo Sapiens
  allele 24: 10-393-27 : polymorphic base G or C
cttagtattgcagaggatttctasatttcccttagcctgtcctattt

SEQ ID NO: 784 - DNA, 47 bp, Homo Sapiens
  allele 24: 10-393-324 : polymorphic base A or G
gagtctccttgattcatggatggrggaaggggaccccactgtgtgga

SEQ ID NO: 785 - DNA, 47 bp, Homo Sapiens
  allele 24: 12-727-237 : polymorphic base A or G
ctggcagaaatggcttttacgcaractcagcactgatactggtttgt

SEQ ID NO: 786 - DNA, 47 bp, Homo Sapiens
  allele 24: 12-728-224 : polymorphic base A or G
catgtgtgtgtgcgtgtgtgcacrcgcgcgtgcacctcaggtcatca

SEQ ID NO: 787 - DNA, 47 bp, Homo Sapiens
  allele 24: 12-730-142 : polymorphic base A or G
ctgggacagtttggctttaagtartacatcaaattcaggtgtgttcc

SEQ ID NO: 788 - DNA, 47 bp, Homo Sapiens
  allele 24: 12-730-193 : polymorphic base A or G
gtttttcattcaggaatccaggcraaaaagctgtggctacctcagtg

SEQ ID NO: 789 - DNA, 47 bp, Homo Sapiens
  allele 24: 12-731-60 : polymorphic base C or T
gctgccagcattttggaagtcaaytgggagaagagcaggttctcaaa

SEQ ID NO: 790 - DNA, 47 bp, Homo Sapiens
  allele 24: 12-731-119 : polymorphic base C or T
ccctcttttcaatatgatatcccyatcctcttaccttcatggtgccc

SEQ ID NO: 791 - DNA, 47 bp, Homo Sapiens
  allele 24: 12-731-137 : polymorphic base G or T
atcccyatcctcttaccttcatgktgccccttmgttcagagaataaa

SEQ ID NO: 792 - DNA, 47 bp, Homo Sapiens
  allele 24: 12-731-146 : polymorphic base A or C
ctcttaccttcatggtgccccttmgttcagagaataaaccgcacaac

SEQ ID NO: 793 - DNA, 47 bp, Homo Sapiens
  allele 24: 12-731-398 : polymorphic base C or T
catgtggctggtagctattgtatyggacagtgcagaaatagagtgtc

SEQ ID NO: 794 - DNA, 47 bp, Homo Sapiens
  allele 24: 12-732-113 : polymorphic base A or G
tgtttgtttgagttcttgaatgtrctacagtgcaggtgtacttcagg

SEQ ID NO: 795 - DNA, 47 bp, Homo Sapiens
  allele 24: 12-732-164 : polymorphic base A or G
aggaacatgccagcatttatgggrgagggggaggagagggtattaaa

SEQ ID NO: 796 - DNA, 47 bp, Homo Sapiens
  allele 24: 12-732-165 : polymorphic base G or C
ggaacatgccagcatttatgggasagggggaggagagggtattaaac

SEQ ID NO: 797 - DNA, 47 bp, Homo Sapiens
  allele 24: 12-732-445 : polymorphic base C or T
tcaaacccagacagcctgtcaacyggccaccaagcataattatcatg

SEQ ID NO: 798 - DNA, 47 bp, Homo Sapiens
  allele 24: 12-734-201 : polymorphic base T or C
cactcccacctctaacccttcatygggaagagacaatactaagtagt

SEQ ID NO: 799 - DNA, 47 bp, Homo Sapiens
  allele 24: 12-735-42 : polymorphic base G or A
aaattatacaaatgcataggtatrtctataaggtaaattgctagatg

SEQ ID NO: 800 - DNA, 47 bp, Homo Sapiens
  allele 24: 12-736-363 : polymorphic base G or A
ttatgtaaaatcttatatgaaaarctgatcaaaaaaagtaggaacaa

SEQ ID NO: 801 - DNA, 47 bp, Homo Sapiens
  allele 24: 12-737-69 : polymorphic base T or C
tggctcctgaaaaactttcctttycaaggatacttttccaaacacaa

SEQ ID NO: 802 - DNA, 47 bp, Homo Sapiens
  allele 24: 12-737-296 : polymorphic base G or A
ataacttggctctttccttccctrttctctttctggaggtaatcgta

SEQ ID NO: 803 - DNA, 47 bp, Homo Sapiens
  allele 24: 12-738-429 : polymorphic base G or A
tgcattcacacttaggagaactcrcattcactggctaattctatatt

SEQ ID NO: 804 - DNA, 47 bp, Homo Sapiens
  allele 24: 12-740-112 : polymorphic base A or G
acacttgcctccaccaaaaaaagrgggaatctaaccaggaggtcctt

SEQ ID NO: 805 - DNA, 47 bp, Homo Sapiens
  allele 24: 12-740-118 : polymorphic base C or T
gcctccaccaaaaaaagrgggaayctaaccaggaggtccttcaaaat

SEQ ID NO: 806 - DNA, 47 bp, Homo Sapiens
  allele 24: 12-741-265 : polymorphic base G or A
atgagatcattactggatgtgaaraccttaattaatatgctaatctc

SEQ ID NO: 807 - DNA, 47 bp, Homo Sapiens
  allele 24: 12-741-327 : polymorphic base T or A
atcgaaagagtgaggtttacaatstttatcccaatgttgttgtcatc

SEQ ID NO: 808 - DNA, 47 bp, Homo Sapiens
  allele 24: 12-741-376 : polymorphic base G or A
tgagctctacaacagctattcctrtgtgttaccaaaattcactcaat

SEQ ID NO: 809 - DNA, 47 bp, Homo Sapiens
  allele 24: 12-745-30 : polymorphic base G or A
aagcatctgatgagagcagggccrtcgtggaggagtcaagccattgc

SEQ ID NO: 810 - DNA, 47 bp, Homo Sapiens
  allele 24: 12-745-75 : polymorphic base T or C
ccatcccctcctcctctgggcgaygcctgcctgtaggaacaggaaaa

SEQ ID NO: 811 - DNA, 47 bp, Homo Sapiens
  allele 24: 12-745-343 : polymorphic base T or G
ataaactcagcatctgmctccgakatgctgtcccaggctaacagacc

SEQ ID NO: 812 - DNA, 47 bp, Homo Sapiens
  allele 24: 12-745-350 : polymorphic base C or A
tttacacataaactcagcatctgmctccgagatgctgtcccaggcta

SEQ ID NO: 813 - DNA, 47 bp, Homo Sapiens
  allele 24: 12-746-320 : polymorphic base C or T
cttttaaatcaatttttagttttyaaatgactcccgtctccagtcct

SEQ ID NO: 814 - DNA, 47 bp, Homo Sapiens
  allele 24: 12-747-181 : polymorphic base C or T
gcatgcggtttcccagccagaggyaacatctctcacattctcttaca

SEQ ID NO: 815 - DNA, 47 bp, Homo Sapiens
  allele 24: 12-747-302 : polymorphic base C or T
ccttaaaaggcataacgcacttcytcctggacattttcctgctctac

SEQ ID NO: 816 - DNA, 47 bp, Homo Sapiens
  allele 24: 12-749-240 : polymorphic base A or G
tacacaaagaacttctcctgatgrctagcttaggcaaggttcaaggt

SEQ ID NO: 817 - DNA, 47 bp, Homo Sapiens
  allele 24: 12-749-255 : polymorphic base G or T
tcctgatggctagcttaggcaagkttcaaggtacaagactagacaag

SEQ ID NO: 818 - DNA, 47 bp, Homo Sapiens
  allele 24: 12-752-37 : polymorphic base G or A
tccttaactttggtgacaacccaraagaaattagaatcaattgtcca

SEQ ID NO: 819 - DNA, 47 bp, Homo Sapiens
  allele 24: 12-752-85 : polymorphic base C or G
ctaaggctgatcccaaagcaacawtccttacgagtcgaactttttag

SEQ ID NO: 820 - DNA, 47 bp, Homo Sapiens
  allele 24: 12-752-196 : polymorphic base T or C
tgaagtacataagctatagtctgyactgtcttcctccttttggttaa

SEQ ID NO: 821 - DNA, 47 bp, Homo Sapiens
  allele 24: 12-752-484 : polymorphic base T or C
gctcagttatgtgaacttaacaaygtttacatgtttaaaaaataaga

SEQ ID NO: 822 - DNA, 47 bp, Homo Sapiens
  allele 24: 12-753-139 : polymorphic base C or T
tttaccccatattttatcttttayaggcaataaaacataaaaacctt

SEQ ID NO: 823 - DNA, 47 bp, Homo Sapiens
  allele 24: 12-753-376 : polymorphic base C or T
tatttctttaagtagttagggagyctctagccctttctcttgtttct

SEQ ID NO: 824 - DNA, 47 bp, Homo Sapiens
  allele 24: 12-754-172 : polymorphic base C or T
atgtttatcctgctgggtgccccyctttctttctgcaatggaagaac

SEQ ID NO: 825 - DNA, 47 bp, Homo Sapiens
  allele 24: 12-754-218 : polymorphic base C or T
cccgcttccattttgcaagtctgygtgtgccccctcgtttggagcca

SEQ ID NO: 826 - DNA, 47 bp, Homo Sapiens
  allele 24: 12-754-328 : polymorphic base G or C
gagctgctaccctaattcctcccsttcacttcgaagcttgtcagggg

SEQ ID NO: 827 - DNA, 47 bp, Homo Sapiens
  allele 24: 12-754-396 : polymorphic base G or T
tcaataggaaaacaaatcccaccktattaagtcttgtttgatcttaa

SEQ ID NO: 828 - DNA, 47 bp, Homo Sapiens
  allele 24: 12-755-280 : polymorphic base G or C
atttcatttatcctacccactctsctaagagcggctcccccggggat

SEQ ID NO: 829 - DNA, 47 bp, Homo Sapiens
  allele 24: 12-757-384 : polymorphic base C or T
taactgtaaaatatatatcatttytatggcttcaaaataatctactt

SEQ ID NO: 830 - DNA, 47 bp, Homo Sapiens
  allele 24: 12-758-257 : polymorphic base A or C
ctttcactgtacatgtctctcagmcttcaatccctccgtgtctctca

SEQ ID NO: 831 - DNA, 47 bp, Homo Sapiens
  allele 24: 12-758-374 : polymorphic base A or C
gtcataaaaacttctctcagtaamtgcctaatttactcaactctttc

SEQ ID NO: 832 - DNA, 47 bp, Homo Sapiens
  allele 24: 12-758-424 : polymorphic base A or G
cctaaaaatctccatactttgggragaaatagtcactgcatgccgta

SEQ ID NO: 833 - DNA, 46 bp, Homo Sapiens
  allele 23: 12-761-23 : polymorphic base G or A
gtggttagaaaaatcatttttgtrttcctcatcagaaatctacagg

SEQ ID NO: 834 - DNA, 47 bp, Homo Sapiens
  allele 24: 12-761-178 : polymorphic base G or A
ggaacccataagtcctggtcctgraagctgtcagccaccaaagtgat

SEQ ID NO: 835 - DNA, 47 bp, Homo Sapiens
  allele 24: 12-764-329 : polymorphic base G or A
gctgtcagcaacacctccccgtgrcattcccttggcaaagctattgc

SEQ ID NO: 836 - DNA, 47 bp, Homo Sapiens
  allele 24: 12-764-377 : polymorphic base G or A
gtgaatgatttatgggacccatgrcccccaggtttctactggcacct

SEQ ID NO: 837 - DNA, 47 bp, Homo Sapiens
  allele 24: 12-765-168 : polymorphic base G or A
gtatgttaataagattttctcatrtattaagagttttctatcatcaa

SEQ ID NO: 838 - DNA, 47 bp, Homo Sapiens
  allele 24: 12-765-504 : polymorphic base T or C
atccccacaagatggcgctcttcyttattttccattcatcttaattt

SEQ ID NO: 839 - DNA, 47 bp, Homo Sapiens
  allele 24: 10-372-279 : polymorphic base C or T
caatcagaggaattggtgagtgayattttacaattcctttcttaatg

SEQ ID NO: 840 - DNA, 47 bp, Homo Sapiens
  allele 24: 10-375-136 : polymorphic base C or T
aaattagattttcttttccttttyagggcgcgggaacaaacgaagat

SEQ ID NO: 841 - DNA, 47 bp, Homo Sapiens
  allele 24: 10-376-281 : polymorphic base A or T
tgtaaggttttattttttattttwtaactccccagtaagctgcatgc

SEQ ID NO: 842 - DNA, 47 bp, Homo Sapiens
  allele 24: 10-369-392 : polymorphic base C or T
aaaatagtagcagcaaaatatccyttattttcagctctaaaatccca

SEQ ID NO: 843 - DNA, 47 bp, Homo Sapiens
  allele 24: 10-371-257 : polymorphic base A or C
agttaagaatctttatagttctamtccattaaatataaagcaagata

SEQ ID NO: 844 - DNA, 47 bp, Homo Sapiens
  allele 24: 12-513-389 : polymorphic base C or T
aagtttcctagtcttatttcctgyccatcagttgacagtagtatgac

SEQ ID NO: 845 - DNA, 45 bp, Homo Sapiens
  allele 24: 12-513-494 : polymorphic base G or C
aggatggccatgcaagtatcattsagagtaggcgtgaggtttcaa

SEQ ID NO: 846 - DNA, 47 bp, Homo Sapiens
  allele 24: 12-515-394 : polymorphic base A or T
taaatagaatttgacatctgatawcttcatgaaaaatatttttcttg

SEQ ID NO: 847 - DNA, 47 bp, Homo Sapiens
  allele 24: 12-516-97 : polymorphic base C or T
aaaggagaggaaagacagatactyggctaattggcaaggacagcata

SEQ ID NO: 848 - DNA, 47 bp, Homo Sapiens
  allele 24: 12-520-287 : polymorphic base A or T
atgtgagtgtctgagtgtgtgtgwgagagagagagagggagagaggg

SEQ ID NO: 849 - DNA, 47 bp, Homo Sapiens
  allele 24: 12-520-323 : polymorphic base A or G
gggagagagggagggatatggggragggaagcagtgcttgtctcttt

SEQ ID NO: 850 - DNA, 47 bp, Homo Sapiens
  allele 24: 12-523-179 : polymorphic base G or A
agagcctcaatttctatgtgagtratgctctctgaggctacaaagga

SEQ ID NO: 851 - DNA, 47 bp, Homo Sapiens
  allele 24: 12-523-270 : polymorphic base G or A
ttgaggttaaggtcttaagagccragtgaaacttttaccattcagga

SEQ ID NO: 852 - DNA, 47 bp, Homo Sapiens
  allele 24: 12-527-367 : polymorphic base T or A
tgcaatttaaaactaacttttttsaaaaaaaatgttttaatgggaac

SEQ ID NO: 853 - DNA, 47 bp, Homo Sapiens
  allele 24: 12-529-376 : polymorphic base T or C
tcttcttttctgtggaggacataygggcatctgagaagcagatggca

SEQ ID NO: 854 - DNA, 47 bp, Homo Sapiens
  allele 24: 12-529-489 : polymorphic base T or C
cctgaaatgaagtgggtgctcaaygtattaattaataggaaggagga

SEQ ID NO: 855 - DNA, 47 bp, Homo Sapiens
  allele 24: 12-530-134 : polymorphic base A or T
aagacaccgaggaagagagcaccwcccactgaagctgggcgtgaatt

SEQ ID NO: 856 - DNA, 47 bp, Homo Sapiens
  allele 24: 12-530-393 : polymorphic base C or T
tttattccctgtggatggacatgytttgtctgattttgatacatatg

SEQ ID NO: 857 - DNA, 47 bp, Homo Sapiens
  allele 24: 12-531-173 : polymorphic base C or T
tttagcttaagagtaaggggaagycattgaagagttctgggcatgag

SEQ ID NO: 858 - DNA, 47 bp, Homo Sapiens
  allele 24: 12-539-441 : polymorphic base C or T
ttacctggaaacacaaacgaaaaygaatgagaggaagatgaagaata

SEQ ID NO: 859 - DNA, 47 bp, Homo Sapiens
  allele 24: 12-543-78 : polymorphic base G or A
gaactaataacacaccgctgacgrgtgacacacagcaatagtggcaa

SEQ ID NO: 860 - DNA, 47 bp, Homo Sapiens
  allele 24: 12-543-79 : polymorphic base C or G
tgaactaataacacaccgctgacwggtgacacacagcaatagtggca

SEQ ID NO: 861 - DNA, 47 bp, Homo Sapiens
  allele 24: 12-546-235 : polymorphic base C or T
gaataatgcctggctatagtcgaygctcataagcatttgctggatga

SEQ ID NO: 862 - DNA, 47 bp, Homo Sapiens
  allele 24: 12-549-287 : polymorphic base T or C
tgaattttacaatctgtaataacygacttgacgttgggccttattat

SEQ ID NO: 863 - DNA, 47 bp, Homo Sapiens
  allele 24: 12-550-287 : polymorphic base A or G
aaacagcgtgactcactgggaaarctagtatttcagccagacagaag

SEQ ID NO: 864 - DNA, 47 bp, Homo Sapiens
  allele 24: 12-552-175 : polymorphic base G or A
tgtcatctgcacggacaacctgtrtgatcagacatgcccatcagttt

SEQ ID NO: 865 - DNA, 47 bp, Homo Sapiens
  allele 24: 12-554-330 : polymorphic base G or T
cactggccttattcaatcaagtcktagtgtatatgacttttcttgga

SEQ ID NO: 866 - DNA, 47 bp, Homo Sapiens
  allele 24: 12-556-312 : polymorphic base A or C
aaggaaacaaatcagggccaatcmaatgtggagactgcatatggaga

SEQ ID NO: 867 - DNA, 47 bp, Homo Sapiens
  allele 24: 12-556-443 : polymorphic base C or T
agccttagtttttattggggtttygttatataagcatgattggttga

SEQ ID NO: 868 - DNA, 47 bp, Homo Sapiens
  allele 24: 12-558-205 : polymorphic base C or G
ggaaagtgtaacaaagaatgtcawaaggaaaggccaagtaaccagaa

SEQ ID NO: 869 - DNA, 47 bp, Homo Sapiens
  allele 24: 12-558-238 : polymorphic base T or C
acagggatggagtaaatcactaaytaaaaagtggaaagtgtaacaaa

SEQ ID NO: 870 - DNA, 47 bp, Homo Sapiens
  allele 24: 12-558-305 : polymorphic base T or A
cattggccagagtgcctctgggasggggatggggaaggggaaaatcc

SEQ ID NO: 871 - DNA, 47 bp, Homo Sapiens
  allele 24: 12-769-39 : polymorphic base G or T
ttctcacaataaaataaactagakaaaaaatgttattaagaagtgga

SEQ ID NO: 872 - DNA, 47 bp, Homo Sapiens
  allele 24: 12-769-430 : polymorphic base C or T
gatgaatatactccactgttactytgagagcaggaggcagccgtcta

SEQ ID NO: 873 - DNA, 47 bp, Homo Sapiens
  allele 24: 12-770-73 : polymorphic base G or A
acacacctttccttcctttctggrttggtggggtgtgtccaggaggc

SEQ ID NO: 874 - DNA, 47 bp, Homo Sapiens
  allele 24: 12-772-200 : polymorphic base G or A
atgagaattcctgggaaggaagcrtatttcctctgtctcctgacatc

SEQ ID NO: 875 - DNA, 47 bp, Homo Sapiens
  allele 24: 12-772-254 : polymorphic base T or C
actgggtagggagatgggatgatygagggaggataacagtaggataa

SEQ ID NO: 876 - DNA, 47 bp, Homo Sapiens
  allele 24: 10-87-73 : polymorphic base C or T
gcgcgccttagcagcagcagcagywgcagcagcatcggagtaccccc

SEQ ID NO: 877 - DNA, 47 bp, Homo Sapiens
  allele 24: 10-87-74 : polymorphic base A or T
cgcgccttagcagcagcagcagcwgcagcagcatcggagtacccccg

SEQ ID NO: 878 - DNA, 47 bp, Homo Sapiens
  allele 24: 10-87-80 : polymorphic base A or G
ttagcagcagcagcagcwgcagcrgcatcggagtacccccgccgtcg

SEQ ID NO: 879 - DNA, 47 bp, Homo Sapiens
  allele 24: 10-87-140 : polymorphic base C or T
tggtgcagccaccctcgctccctytgctcttcctcccttcgctcgca

SEQ ID NO: 880 - DNA, 47 bp, Homo Sapiens
  allele 24: 10-88-81 : polymorphic base C or T
atattaaaagtataactggaaaayctatgttgaaatcaaccaaacat

SEQ ID NO: 881 - DNA, 47 bp, Homo Sapiens
  allele 24: 10-89-41 : polymorphic base A or G
agcccccggcaagtgtgtattgtractgggttggataaagacattga

SEQ ID NO: 882 - DNA, 47 bp, Homo Sapiens
  allele 24: 10-90-35 : polymorphic base A or G
ctttgtcctagtacatgtttaccrttccgtacagtggttctgaaatg

SEQ ID NO: 883 - DNA, 47 bp, Homo Sapiens
  allele 24: 10-91-274 : polymorphic base G or T
tttcatagtcttacctttagatckgtaagcaagccaactgcttcact

SEQ ID NO: 884 - DNA, 47 bp, Homo Sapiens
  allele 24: 10-93-133 : polymorphic base C or T
aaatgggttctagttcaatttgtytagtataaattgtcatagctggt

SEQ ID NO: 885 - DNA, 47 bp, Homo Sapiens
  allele 24: 10-94-197 : polymorphic base A or G
tccattccaagttgtaaatgctartcttttttttttttttttccaat

SEQ ID NO: 886 - DNA, 47 bp, Homo Sapiens
  allele 24: 10-94-198 : polymorphic base G or T
ccattccaagttgtaaatgctagkcttttttttttttttttccaata

SEQ ID NO: 887 - DNA, 42 bp, Homo Sapiens
  allele 24: 10-166-362 : polymorphic base A or C
acacctgacccgagaccgcgcgcmcagcctagaacgcttccc

SEQ ID NO: 888 - DNA, 47 bp, Homo Sapiens
  allele 24: 10-207-386 : polymorphic base G or C
  misc_feature 46: n=a, g, c or t
aggctctttgttagggaactgatsgaaattagtgacccttcccccna

SEQ ID NO: 889 - DNA, 47 bp, Homo Sapiens
  allele 24: 10-207-409 : polymorphic base G or C
tcgaaattagtgacccttcccccsaaattaggttgctaaaacagtta

SEQ ID NO: 890 - DNA, 47 bp, Homo Sapiens
  allele 24: 10-118-307 : polymorphic base A or G
ttgttacttgctttttaaactttrtttagccacttaaaatctgctta

SEQ ID NO: 891 - DNA, 47 bp, Homo Sapiens
  allele 24: 10-173-247 : polymorphic base A or G
ctcaataaggggcgggaaagtggrtgagtgtggcagggaaggatacg

SEQ ID NO: 892 - DNA, 47 bp, Homo Sapiens
  allele 24: 10-173-294 : polymorphic base A or G
tggaagaggaaggttctccagccragcgcaaagcaggcgactctgcc

SEQ ID NO: 893 - DNA, 47 bp, Homo Sapiens
  allele 24: 10-173-347 : polymorphic base C or T
cgcagttgccaggacagcgcggcycgagcagcaacggcagaagccgc

SEQ ID NO: 894 - DNA, 47 bp, Homo Sapiens
  allele 24: 10-103-104 : polymorphic base C or T
gtgacctctgactcctcccccttyttcccccagagttcaaggaggcc

SEQ ID NO: 895 - DNA, 47 bp, Homo Sapiens
  allele 24: 10-103-323 : polymorphic base C or T
cccgagtgactgcagggagcctcyctcagggtgatggatgagcccgt

SEQ ID NO: 896 - DNA, 47 bp, Homo Sapiens
  allele 24: 10-103-402 : polymorphic base C or T
tcctttccccaccttccagggaaygggaccattgacttcccggagtt

SEQ ID NO: 897 - DNA, 47 bp, Homo Sapiens
  allele 24: 10-106-98 : polymorphic base A or C
cccgttctcttgatctctctcttmtcgcgcgcgcactctctcttcaa

SEQ ID NO: 898 - DNA, 47 bp, Homo Sapiens
  allele 24: 10-106-288 : polymorphic base C or T
tttgccctcgcctcttccatccaygtcttccaaggcctgatgcattc

SEQ ID NO: 899 - DNA, 47 bp, Homo Sapiens
  allele 24: 10-106-378 : polymorphic base C or T
cctccagcccggatggctctcctycattttggtttgtttcctcttgt

SEQ ID NO: 900 - DNA, 47 bp, Homo Sapiens
  allele 24: 10-168-160 : polymorphic base C or T
tccattctgttccaggtggagcayaatgattggtccagcctgactcg

SEQ ID NO: 901 - DNA, 47 bp, Homo Sapiens
  allele 24: 10-168-206 : polymorphic base A or C
gtttgcccatctcttaaccatcamcatggtggggaggggacacgcag

SEQ ID NO: 902 - DNA, 47 bp, Homo Sapiens
  allele 24: 10-168-284 : polymorphic base A or T
agggggcaggggtgatcattttcwgagctcctataaacaaagtttca

SEQ ID NO: 903 - DNA, 47 bp, Homo Sapiens
  allele 24: 10-169-318 : polymorphic base A or C
actgaatgaataccccgttcccamaggctgtcctgggatggtcctaa

SEQ ID NO: 904 - DNA, 47 bp, Homo Sapiens
  allele 24: 12-86-79 : polymorphic base G or A
gagtaggagtttgcagtgctcatrtgggaaatgctgctgctatactt

SEQ ID NO: 905 - DNA, 47 bp, Homo Sapiens
  allele 24: 12-88-393 : polymorphic base C or A
ttaacttttaaagtctgggattcmgttaaatccaagaaacttttttt

SEQ ID NO: 906 - DNA, 47 bp, Homo Sapiens
  allele 24: 12-89-369 : polymorphic base G or C
ctcaaacaacagctctggactcasagctaatagacttcctgagtcca

SEQ ID NO: 907 - DNA, 47 bp, Homo Sapiens
  allele 24: 12-89-91 : polymorphic base A or G
ttactgtggcacgatgcttttgcrttgtgacacagcatagctacagg

SEQ ID NO: 908 - DNA, 47 bp, Homo Sapiens
  allele 24: 12-94-210 : polymorphic base C or T
ataaaatcctaaaataaaagccayaaaatctttgtgtttaggtgtgc

SEQ ID NO: 909 - DNA, 47 bp, Homo Sapiens
  allele 24: 12-94-516 : polymorphic base A or T
ttgactgagtttaccgattagacwgttttatatttgtctctgctaaa

SEQ ID NO: 910 - DNA, 47 bp, Homo Sapiens
  allele 24: 12-96-64 : polymorphic base C or A
ccagaaagaaaaaaatagatgccmctttatcaactaatatggaccca

SEQ ID NO: 911 - DNA, 47 bp, Homo Sapiens
  allele 24: 12-97-83 : polymorphic base A or C
aataaagccaattgaggtcttcamactaaatattttggaattgtatc

SEQ ID NO: 912 - DNA, 47 bp, Homo Sapiens
  allele 24: 12-99-296 : polymorphic base G or A
tagacttaccaactcaaagaatgraaggattctagaaacattatagt

SEQ ID NO: 913 - DNA, 47 bp, Homo Sapiens
  allele 24: 12-100-266 : polymorphic base T or C
tgtggaaataaataacctagacayctaagagtcaaaccttttgaaaa

SEQ ID NO: 914 - DNA, 47 bp, Homo Sapiens
  allele 24: 12-811-174 : polymorphic base T or C
ctagggaagcagagctggcttcaytgaatgcatgtagttgacaaggt

SEQ ID NO: 915 - DNA, 47 bp, Homo Sapiens
  allele 24: 12-815-94 : polymorphic base A or G
atttcttccacttctattttatgrtagggcattgctgaacacttctg

SEQ ID NO: 916 - DNA, 47 bp, Homo Sapiens
  allele 24: 12-815-383 : polymorphic base A or G
atactttctttcccaggctccttrcttcctctctttttcctttgtgc

SEQ ID NO: 917 - DNA, 47 bp, Homo Sapiens
  allele 24: 12-815-384 : polymorphic base G or C
tactttctttcccaggctccttasttcctctctttttcctttgtgcc

SEQ ID NO: 918 - DNA, 47 bp, Homo Sapiens
  allele 24: 12-815-391 : polymorphic base C or T
tttcccaggctccttacttcctcyctttttcctttgtgcctgaagtt

SEQ ID NO: 919 - DNA, 47 bp, Homo Sapiens
  allele 24: 12-817-214 : polymorphic base A or G
tttatatttacaaacgtggaaaargatacagatgagaagatccagga

SEQ ID NO: 920 - DNA, 47 bp, Homo Sapiens
  allele 24: 12-817-355 : polymorphic base C or T
atggcacagatgtgcacatactayatacacttaagcagttgttgagt

SEQ ID NO: 921 - DNA, 47 bp, Homo Sapiens
  allele 24: 12-819-437 : polymorphic base A or G
tcgggttcatctctgagatctgcrtctttgtgcaccacagggcatcc

SEQ ID NO: 922 - DNA, 47 bp, Homo Sapiens
  allele 24: 12-821-62 : polymorphic base T or G
taggagactaacaagcacttaagkgggggtttgaccccaaatctgga

SEQ ID NO: 923 - DNA, 47 bp, Homo Sapiens
  allele 24: 12-821-483 : polymorphic base T or G
catttaatacttctaaccgctgtktgaggtgggtactgttatttcca

SEQ ID NO: 924 - DNA, 47 bp, Homo Sapiens
  allele 24: 12-825-173 : polymorphic base A or C
aataaagttctcctgtctcacccmatggcctctccagtcctccttca

SEQ ID NO: 925 - DNA, 47 bp, Homo Sapiens
  allele 24: 12-826-312 : polymorphic base G or A
  misc_feature 19: n=a, g, c or t
tgtctgctgggcccttgcnacttragaactggagttgggcactagag

SEQ ID NO: 926 - DNA, 47 bp, Homo Sapiens
  allele 24: 12-831-59 : polymorphic base C or G
ctgttaaatatgatgaaactgcawgatcacaaagttatgtggcttac

SEQ ID NO: 927 - DNA, 47 bp, Homo Sapiens
  allele 24: 12-833-264 : polymorphic base T or A
agctatgtgaccttgagcaaattsctcagcctctctgttcctcaaat

SEQ ID NO: 928 - DNA, 47 bp, Homo Sapiens
  allele 24: 12-833-279 : polymorphic base G or A
actttgatatttacaagctatgtraccttgagcaaattactcagcct

SEQ ID NO: 929 - DNA, 47 bp, Homo Sapiens
  allele 24: 12-833-280 : polymorphic base T or C
gactttgatatttacaagctatgygaccttgagcaaattactcagcc

SEQ ID NO: 930 - DNA, 47 bp, Homo Sapiens
  allele 24: 12-833-373 : polymorphic base G or A
ccagagactaattgttcctgcctraggggcaatagcataattgttta

SEQ ID NO: 931 - DNA, 47 bp, Homo Sapiens
  allele 24: 12-834-183 : polymorphic base A or G
ttttctcagtcaacaaatgaacartgtaaaacaaaccatagctttgc

SEQ ID NO: 932 - DNA, 47 bp, Homo Sapiens
  allele 24: 12-835-54 : polymorphic base A or G
aattccactcattctgctacatgrctgagttgtaaaaagtagatccc

SEQ ID NO: 933 - DNA, 47 bp, Homo Sapiens
  allele 24: 12-836-134 : polymorphic base C or T
gattcctttcttttctaaatatgygtgtctgcttgagtgcatgcctg

SEQ ID NO: 934 - DNA, 47 bp, Homo Sapiens
  allele 24: 12-836-237 : polymorphic base A or G
tgagagcaagagcaagcgagcgartgagagagagagagagagaaaaa

SEQ ID NO: 935 - DNA, 47 bp, Homo Sapiens
  allele 24: 12-836-238 : polymorphic base A or T
gagagcaagagcaagcgagcgaawgagagagagagagagagaaaaac

SEQ ID NO: 936 - DNA, 47 bp, Homo Sapiens
  allele 24: 12-836-257 : polymorphic base A or G
cgaatgagagagagagagagagaraaactaaagggaatacacccagc

SEQ ID NO: 937 - DNA, 47 bp, Homo Sapiens
  allele 24: 12-836-275 : polymorphic base A or C
agagaaaaactaaagggaatacamccagctgtatttagtttccagag

SEQ ID NO: 938 - DNA, 47 bp, Homo Sapiens
  allele 24: 12-838-179 : polymorphic base A or G
ttcactctaatggtagctactgtrtatttttttaaatgcatgaaagt

SEQ ID NO: 939 - DNA, 47 bp, Homo Sapiens
  allele 24: 12-839-397 : polymorphic base G or A
tacatgttggagtagaaaccggaratttcatttaaaaaattacttgt

SEQ ID NO: 940 - DNA, 47 bp, Homo Sapiens
  allele 24: 12-840-47 : polymorphic base C or G
acccctttatttttaaatgcttawcagtatgccatagccctagtcca

SEQ ID NO: 941 - DNA, 47 bp, Homo Sapiens
  allele 24: 12-840-77 : polymorphic base T or C
tactcagataatgcaaatccgggycatcatacccctttatttttaaa

SEQ ID NO: 942 - DNA, 47 bp, Homo Sapiens
  allele 24: 12-841-445 : polymorphic base G or C
taagtctcctcataaaggaaaaasgtgctgtatcattcaagtgcttt

SEQ ID NO: 943 - DNA, 47 bp, Homo Sapiens
  allele 24: 12-842-215 : polymorphic base T or C
tccttagaatccagtcctgattaygtaacttttaaaggacatgaatc

SEQ ID NO: 944 - DNA, 45 bp, Homo Sapiens
  allele 24: 12-842-447 : polymorphic base G or A
tcccacaattttgctttctacrtttaccacttgaaattatttagt

SEQ ID NO: 945 - DNA, 47 bp, Homo Sapiens
  allele 24: 12-844-167 : polymorphic base T or C
ggaggagatagaaaagcaagaacycaatactgagcattactaaccac

SEQ ID NO: 946 - DNA, 47 bp, Homo Sapiens
  allele 24: 12-845-364 : polymorphic base G or A
aatcctaggacattagggctggargaaatagggaactccctgctcag

SEQ ID NO: 947 - DNA, 47 bp, Homo Sapiens
  allele 24: 12-846-209 : polymorphic base A or T
ccccactccccaataaatattcawtccaagtaaaatagtggtttttt

SEQ ID NO: 948 - DNA, 47 bp, Homo Sapiens
  allele 24: 12-847-123 : polymorphic base A or G
aatctgtgactgtgaaagatggtracactgccaggtataaggaagga

SEQ ID NO: 949 - DNA, 47 bp, Homo Sapiens
  allele 24: 12-849-242 : polymorphic base C or A
acccaggcattcccattctaaacmcagtcgcattgcaatccctgcaa

SEQ ID NO: 950 - DNA, 47 bp, Homo Sapiens
  allele 24: 10-336-58 : polymorphic base C or T
tccaaatcccagctctactgtctygtccgaattagccttgggaaaat

SEQ ID NO: 951 - DNA, 47 bp, Homo Sapiens
  allele 24: 10-336-137 : polymorphic base A or T
taggagatgaaaagaggataatgwttccttccataaagaaagttctt

SEQ ID NO: 952 - DNA, 47 bp, Homo Sapiens
  allele 24: 10-336-232 : polymorphic base A or G
aacacatcataaaagttctatctrtagtgtgcctccttcctgcttcc

SEQ ID NO: 953 - DNA, 47 bp, Homo Sapiens
  allele 24: 12-102-104 : polymorphic base A or G
aagggagaaaatcgaactttgtgrtgttggattggaatctgatgtaa

SEQ ID NO: 954 - DNA, 47 bp, Homo Sapiens
  allele 24: 12-102-111 : polymorphic base A or G
aaaatcgaactttgtgrtgttggrttggaatctgatgtaatctacaa

SEQ ID NO: 955 - DNA, 47 bp, Homo Sapiens
  allele 24: 12-102-275 : polymorphic base A or G
atatgtacacacacacacttttgracatatacccacattatatacat

SEQ ID NO: 956 - DNA, 47 bp, Homo Sapiens
  allele 24: 12-103-202 : polymorphic base C or T
tgcgatccaagacaaccccacgcyggctgtgccacagggcccacatg

SEQ ID NO: 957 - DNA, 47 bp, Homo Sapiens
  allele 24: 12-103-214 : polymorphic base A or G
caaccccacgctggctgtgccacrgggcccacatggagtcccacacc

SEQ ID NO: 958 - DNA, 47 bp, Homo Sapiens
  allele 24: 12-104-351 : polymorphic base T or G
ttttaaaaaaattttcagccatcktctgaactttacagcaatatttt

SEQ ID NO: 959 - DNA, 46 bp, Homo Sapiens
  allele 24: 12-105-435 : polymorphic base A or G
aagcagctttatgaaatacatgarcccagtcctctctttccagtta

SEQ ID NO: 960 - DNA, 47 bp, Homo Sapiens
  allele 24: 12-109-149 : polymorphic base A or G
ggattcttgctgaaggcaaacccragtgatcaggtaccaagggtggg

SEQ ID NO: 961 - DNA, 47 bp, Homo Sapiens
  allele 24: 12-109-197 : polymorphic base A or G
gatgaatatttggatcagatatcraggggtcaggggtcgcctctaaa

SEQ ID NO: 962 - DNA, 47 bp, Homo Sapiens
  allele 24: 12-109-209 : polymorphic base A or G
gatcagatatcgaggggtcagggrtcgcctctaaactgacatgctgc

SEQ ID NO: 963 - DNA, 47 bp, Homo Sapiens
  allele 24: 12-109-284 : polymorphic base A or G
gatgccaaggtcaatgcctagagrgtttagaggagctgagtctttgt

SEQ ID NO: 964 - DNA, 47 bp, Homo Sapiens
  allele 24: 12-113-276 : polymorphic base T or C
cttgtggctcatcaaacaccatcyttactcaatatgggttaagaacc

SEQ ID NO: 965 - DNA, 47 bp, Homo Sapiens; identical to SEQ ID NO: 952
  allele 24: 12-115-57 : polymorphic base A or G

SEQ ID NO: 966 - DNA, 47 bp, Homo Sapiens
  allele 24: 12-119-26 : polymorphic base T or C
agaaataatgaaaaacaaaactaytgggtaggacctagccttataca

SEQ ID NO: 967 - DNA, 47 bp, Homo Sapiens
  allele 24: 12-347-308 : polymorphic base A or G
aaggaaaattcctcatacataggraaggtgttcaaaggggctgggaa

SEQ ID NO: 968 - DNA, 47 bp, Homo Sapiens
  allele 24: 12-354-334 : polymorphic base G or A
gagaaggcagggaaactgaggcargcagtgatacttttggtggccgt

SEQ ID NO: 969 - DNA, 47 bp, Homo Sapiens
  allele 24: 12-357-140 : polymorphic base C or T
gcctttgggctgcgtgtgtctggyatgcagcgtggtgtgctgatcat

SEQ ID NO: 970 - DNA, 47 bp, Homo Sapiens
  allele 24: 12-361-320 : polymorphic base G or T
tattcccttggtctgtgaccttcktctggatcctagagcccagaccc

SEQ ID NO: 971 - DNA, 47 bp, Homo Sapiens
  allele 24: 12-361-388 : polymorphic base A or G
tgattccatcaggaatgggggctraggcagctgagaccttggagtcc

SEQ ID NO: 972 - DNA, 47 bp, Homo Sapiens
  allele 24: 12-365-251 : polymorphic base G or C
gagcgtttgctgagcctagtgatsgagcgtaagaatgactttacagg

SEQ ID NO: 973 - DNA, 47 bp, Homo Sapiens
  allele 24: 12-374-261 : polymorphic base G or A
acctcctcaagagagagggagagrggtttgcaaggatgccggaagcc

SEQ ID NO: 974 - DNA, 47 bp, Homo Sapiens
  allele 24: 10-308-116 : polymorphic base C or T
cctctgcagggagtctcttgctcyggttcttgctgttcctgctcctg

SEQ ID NO: 975 - DNA, 47 bp, Homo Sapiens
  allele 24: 10-311-274 : polymorphic base C or T
ctgggcctggggattacaggaggygctcagttcttctctttgggaaa

SEQ ID NO: 976 - DNA, 47 bp, Homo Sapiens
  allele 24: 10-314-76 : polymorphic base C or T
agggagttggttgtgggcagctgygggtgacccccaaccccaggttg

SEQ ID NO: 977 - DNA, 47 bp, Homo Sapiens
  allele 24: 10-306-265 : polymorphic base A or G
tgcctgcactgagagggcaaggargtggggtgttcttcttgggaccc

SEQ ID NO: 978 - DNA, 47 bp, Homo Sapiens
  allele 24: 10-52-386 : polymorphic base C or T
gaaagagcttggaccgctagagtycgaaagaactccgtggatattcc

SEQ ID NO: 979 - DNA, 47 bp, Homo Sapiens
  allele 24: 10-62-240 : polymorphic base G or C
cgaaatgcaattatgagttatgtsttgacatgtaagtacaagtgtct

SEQ ID NO: 980 - DNA, 47 bp, Homo Sapiens
  allele 24: 10-65-276 : polymorphic base A or G
actattaagacttagttattaccrcttatacccatattttaaaatcc

SEQ ID NO: 981 - DNA, 47 bp, Homo Sapiens
  allele 24: 10-67-42 : polymorphic base A or T
agatactcaggcagagatgatctwccctcctcaagtccctgagcatc

SEQ ID NO: 982 - DNA, 47 bp, Homo Sapiens
  allele 24: 10-67-340 : polymorphic base C or T
tgtggtaaatgaaaactcacacaytctatatacattaaatatgtaag

SEQ ID NO: 983 - DNA, 47 bp, Homo Sapiens
  allele 24: 10-55-265 : polymorphic base C or T
tgaaattttaaagtacttttggtyatttttctgtcatcaaacaaaaa

SEQ ID NO: 984 - DNA, 47 bp, Homo Sapiens
  allele 24: 10-57-278 : polymorphic base C or T
agtaccaagctgtgcttgaataaygatatgttttctcagattttctg

SEQ ID NO: 985 - DNA, 47 bp, Homo Sapiens
  allele 24: 10-59-176 : polymorphic base C or T
ctagtgcctcagagagaactgtayggggtttgtgactggaaaaagtt

SEQ ID NO: 986 - DNA, 47 bp, Homo Sapiens
  allele 24: 10-60-114 : polymorphic base A or G
ttattaggacactatggttataarctgtgtttaagcctacaatcatt

SEQ ID NO: 987 - DNA, 47 bp, Homo Sapiens
  allele 24: 10-27-176 : polymorphic base A or G
aggagaatggctactcatcacacrctgtggatgggactggccctgct

SEQ ID NO: 988 - DNA, 47 bp, Homo Sapiens
  allele 24: 10-28-242 : polymorphic base A or G
ctcctacagctaccggagtccccrtgagtggggcctccaccggcccc

SEQ ID NO: 989 - DNA, 47 bp, Homo Sapiens
  allele 24: 10-30-349 : polymorphic base A or G
cctgctcgaggcctgggccagggrcagagggggtgagtgttcaagtc

SEQ ID NO: 990 - DNA, 47 bp, Homo Sapiens
  allele 24: 10-181-42 : polymorphic base C or T
tggccccatcagacttcagagtcyctccctggcaggtgacccaggcc

SEQ ID NO: 991 - DNA, 47 bp, Homo Sapiens
  allele 24: 10-181-372 : polymorphic base C or T
ccagctctgtagctgagccaggcytgcgggccacgcggggtcccggg

SEQ ID NO: 992 - DNA, 47 bp, Homo Sapiens
  allele 24: 10-183-260 : polymorphic base G or C
catttcccagctccccacccgggstcaccttcagaccagcggcagcg

SEQ ID NO: 993 - DNA, 47 bp, Homo Sapiens
  allele 24: 10-475-163 : polymorphic base A or G
tgtaaagctgccctggatgagcartttgaacctcagaagactctgtt

SEQ ID NO: 994 - DNA, 47 bp, Homo Sapiens
  allele 24: 12-884-203 : polymorphic base C or T
acattaaatgtaacattttcttaytggtaatttggaccacaaaaaca

SEQ ID NO: 995 - DNA, 47 bp, Homo Sapiens
  allele 24: 10-479-266 : polymorphic base A or G
tagaatataaggatcatatcaagratatgattaaatactatggaatt

SEQ ID NO: 996 - DNA, 47 bp, Homo Sapiens
  allele 24: 10-479-350 : polymorphic base C or T
gatgaagcaaagcattatttagayaagctataaaaagggaagaaata

SEQ ID NO: 997 - DNA, 47 bp, Homo Sapiens
  allele 24: 10-479-394 : polymorphic base A or G
ataagcttatacagttgagaaatraacacaagcttcaaacttttggt

SEQ ID NO: 998 - DNA, 47 bp, Homo Sapiens
  allele 24: 10-482-145 : polymorphic base A or G
tgacactgttgattcacagttcarcctcctatctgggaaagacattt

SEQ ID NO: 999 - DNA, 47 bp, Homo Sapiens
  allele 24: 12-854-64 : polymorphic base A or G
tgtatttatacatttcttgatccrtgtaactctactctctaacttga

SEQ ID NO: 1000 - DNA, 47 bp, Homo Sapiens
  allele 24: 12-854-472 : polymorphic base G or T
ttacagaaataatatttgtatcakgcatgctgatttttgactcgcaa

SEQ ID NO: 1001 - DNA, 47 bp, Homo Sapiens
  allele 24: 12-855-194 : polymorphic base T or G
gcagaggcagcaattacttggctkaacttacagtgacaaaagaagac

SEQ ID NO: 1002 - DNA, 47 bp, Homo Sapiens
  allele 24: 12-855-288 : polymorphic base T or C
cctacagaaacagagagaaccagycaccttgaccaaaggaacatctg

SEQ ID NO: 1003 - DNA, 47 bp, Homo Sapiens
  allele 24: 12-855-423 : polymorphic base T or G
cacatcagtgataattagccctcktttgtgaaagctgtggatgactg

SEQ ID NO: 1004 - DNA, 47 bp, Homo Sapiens
  allele 24: 12-857-25 : polymorphic base C or T
tggtagcaacacgcaagcctttaytggttttgaagtttaccctgcta

SEQ ID NO: 1005 - DNA, 47 bp, Homo Sapiens
  allele 24: 12-858-346 : polymorphic base T or C
ggtttgcactcacttgacctctcytcctcctccctgcaccacccaca

SEQ ID NO: 1006 - DNA, 47 bp, Homo Sapiens
  allele 24: 12-858-443 : polymorphic base G or A
ggagtatttggggaaatgaaagtrtagttatgaagttcctaagaaaa

SEQ ID NO: 1007 - DNA, 47 bp, Homo Sapiens
  allele 24: 12-860-388 : polymorphic base G or A
aatctccactctcacacccaaccrttaatcagaggttgcatagtaaa

SEQ ID NO: 1008 - DNA, 47 bp, Homo Sapiens
  allele 24: 12-861-270 : polymorphic base C or T
gagaaacgaatagtcttctagaayagtgcttctcagatttaatatgt

SEQ ID NO: 1009 - DNA, 47 bp, Homo Sapiens
  allele 24: 12-862-349 : polymorphic base A or G
cttaaaagcaaatcttgtttgcgratttagtatgactgctctgtctg

SEQ ID NO: 1010 - DNA, 47 bp, Homo Sapiens
  allele 24: 12-862-365 : polymorphic base C or T
gtttgcggatttagtatgactgcyctgtctgaggaggtttctgtttt

SEQ ID NO: 1011 - DNA, 46 bp, Homo Sapiens
  allele 24: 12-862-452 : polymorphic base G or T
tgattaaaactggcttttgtaaakatggtagaaagattatgaagaa

SEQ ID NO: 1012 - DNA, 47 bp, Homo Sapiens
  allele 24: 12-866-423 : polymorphic base C or T
gtagcagacacaagatccaaaccyggtttgtctgaatccagtgctga

SEQ ID NO: 1013 - DNA, 47 bp, Homo Sapiens
  allele 24: 12-867-47 : polymorphic base C or T
gttctcccagcatgttgccatttyaccccagcagttccttttctgtc

SEQ ID NO: 1014 - DNA, 47 bp, Homo Sapiens
  allele 24: 12-868-181 : polymorphic base A or G
gtatttcaacaagtaagcattccrttgagccaacaatttggtaggct

SEQ ID NO: 1015 - DNA, 47 bp, Homo Sapiens
  allele 24: 12-868-198 : polymorphic base A or G
cattccattgagccaacaatttgrtaggctaccagcggctctggagc

SEQ ID NO: 1016 - DNA, 47 bp, Homo Sapiens
  allele 24: 12-868-282 : polymorphic base C or T
atatgacacacaattgacactgaycagaaacacagcgccaaggacac

SEQ ID NO: 1017 - DNA, 47 bp, Homo Sapiens
  allele 24: 12-869-128 : polymorphic base A or C
gtttattgtttgtccgtctatttmgtgactgcgcaggcccgcgattc

SEQ ID NO: 1018 - DNA, 47 bp, Homo Sapiens
  allele 24: 12-870-491 : polymorphic base A or G
caaaaattctggagaaaaactagraaagtaaaatatttgtatttcac

SEQ ID NO: 1019 - DNA, 47 bp, Homo Sapiens
  allele 24: 12-872-52 : polymorphic base A or G
gaaaatgtttttagtaaacaactrgcatagtaatttatctatatggc

SEQ ID NO: 1020 - DNA, 47 bp, Homo Sapiens
  allele 24: 12-872-293 : polymorphic base A or G
gtagaatgaatgatcaaaggcccrgggaaacagtttaaatcaattag

SEQ ID NO: 1021 - DNA, 47 bp, Homo Sapiens
  allele 24: 12-873-185 : polymorphic base T or C
ccctccaggaccctccacatgttyagccatccagaaacttttgaatc

SEQ ID NO: 1022 - DNA, 47 bp, Homo Sapiens
  allele 24: 12-873-319 : polymorphic base T or A
ctcaagtacctgtaagcctttttsaaaaaattgcttaccagtttatt

SEQ ID NO: 1023 - DNA, 47 bp, Homo Sapiens
  allele 24: 12-875-248 : polymorphic base T or C
tcttggtctttgtctctacctctytctctctctctcctactctttgt

SEQ ID NO: 1024 - DNA, 47 bp, Homo Sapiens
  allele 24: 12-876-265 : polymorphic base T or A
tgaagttgwaacaatttaccaaasatctctaagcttcaggttcttct

SEQ ID NO: 1025 - DNA, 47 bp, Homo Sapiens
  allele 24: 12-876-280 : polymorphic base C or G
catttacttacagagtgaagttgwaacaatttaccaaatatctctaa

SEQ ID NO: 1026 - DNA, 47 bp, Homo Sapiens
  allele 24: 12-876-454 : polymorphic base G or A
taaaatttgcttaaatattgcaartatttcttctagaaatattatta

SEQ ID NO: 1027 - DNA, 47 bp, Homo Sapiens
  allele 24: 12-877-59 : polymorphic base C or T
ttttgaagtaaaaatagaaagatytatagttacggcaaagaagcgac

SEQ ID NO: 1028 - DNA, 47 bp, Homo Sapiens
  allele 24: 12-877-69 : polymorphic base G or T
aaaatagaaagatctatagttackgcaaagaagcgacattgttagca

SEQ ID NO: 1029 - DNA, 47 bp, Homo Sapiens
  allele 24: 12-877-79 : polymorphic base C or T
gatctatagttacggcaaagaagygacattgttagcatgatctggaa

SEQ ID NO: 1030 - DNA, 47 bp, Homo Sapiens
  allele 24: 12-878-153 : polymorphic base C or T
atgtaatttgtactgcaatactcycaagaacatttttttaaaaaatg

SEQ ID NO: 1031 - DNA, 47 bp, Homo Sapiens
  allele 24: 12-878-419 : polymorphic base G or T
taaacctttaaaagtttgttttakttcttcagatttttttgtttctt

SEQ ID NO: 1032 - DNA, 47 bp, Homo Sapiens
  allele 24: 12-879-67 : polymorphic base G or C
ctaaacgctttacatgtagttctscatgtattaattactccaatact

SEQ ID NO: 1033 - DNA, 47 bp, Homo Sapiens
  allele 24: 12-879-439 : polymorphic base A or G
ctgcttctacttccggaacgccargggagacaattccggttccggga

SEQ ID NO: 1034 - DNA, 47 bp, Homo Sapiens
  allele 24: 12-881-210 : polymorphic base A or G
gtttcttcctgcgcttgcaacatrtaaaattatttttacaaggacct

SEQ ID NO: 1035 - DNA, 47 bp, Homo Sapiens
  allele 24: 12-881-389 : polymorphic base G or T
accgcattactaggtgactttacktacaattccggacatcatgtcat

SEQ ID NO: 1036 - DNA, 47 bp, Homo Sapiens
  allele 24: 12-883-273 : polymorphic base G or C
aatttctcagcagcatccatcctsttcccatctctagctgattgcct

SEQ ID NO: 1037 - DNA, 47 bp, Homo Sapiens
  allele 24: 12-885-196 : polymorphic base T or C
ctgtgttaaagtcctagaaggaaytgacagaagtcaacaccaatagg

SEQ ID NO: 1038 - DNA, 47 bp, Homo Sapiens
  allele 24: 12-885-333 : polymorphic base C or G
gctagagatgggtagttagaggcwaaaaaggcaaagtgataactata

SEQ ID NO: 1039 - DNA, 47 bp, Homo Sapiens
  allele 24: 12-885-407 : polymorphic base T or C
cttgggaaagtggggatatagtgycacaactcacagagatatggaat

SEQ ID NO: 1040 - DNA, 47 bp, Homo Sapiens
  allele 24: 12-885-410 : polymorphic base C or G
tgacttgggaaagtggggatatawtgccacaactcacagagatatgg

SEQ ID NO: 1041 - DNA, 47 bp, Homo Sapiens
  allele 24: 12-886-195 : polymorphic base T or C
aggcataaataaggaactatagaygtaaatgtttggcaactatctgg

SEQ ID NO: 1042 - DNA, 47 bp, Homo Sapiens
  allele 24: 12-886-348 : polymorphic base T or C
caattaaagctatgtccatgattygcaaacttctttgtgagatgatt

SEQ ID NO: 1043 - DNA, 47 bp, Homo Sapiens
  allele 24: 12-887-201 : polymorphic base G or A
ttaggaaatttatttatttcatgrtctttgcataaaatttttgtaca

SEQ ID NO: 1044 - DNA, 47 bp, Homo Sapiens
  allele 24: 12-887-467 : polymorphic base T or C
tccaagactttttagttagcaagycagtggcctgswatttcccttga

SEQ ID NO: 1045 - DNA, 47 bp, Homo Sapiens
  allele 24: 12-888-98 : polymorphic base G or A
ataaaaatgtatttttgaaaaagrttcataacaactgccaggatatt

SEQ ID NO: 1046 - DNA, 47 bp, Homo Sapiens
  allele 24: 12-888-203 : polymorphic base C or A
aacagcccctaattacacctgaamgttaccagctgaaaggcccagaa

SEQ ID NO: 1047 - DNA, 47 bp, Homo Sapiens
  allele 24: 12-888-315 : polymorphic base T or G
aatattctgctggaaaaaacacakgtacacacactacatttcctact

SEQ ID NO: 1048 - DNA, 47 bp, Homo Sapiens
  allele 24: 12-889-518 : polymorphic base G or A
taactactctttcttacagcttarggccaacatcaggatttccctca

SEQ ID NO: 1049 - DNA, 47 bp, Homo Sapiens
  allele 24: 12-894-266 : polymorphic base T or C
gcagtttcatatgtttgtagtacygaggaactttacaagattcctgc

SEQ ID NO: 1050 - DNA, 47 bp, Homo Sapiens
  allele 24: 12-895-391 : polymorphic base G or A
taagtagcccatccaccttgaagrgcacattgcttagtgatttgaac

SEQ ID NO: 1051 - DNA, 47 bp, Homo Sapiens
  allele 24: 12-896-140 : polymorphic base T or A
gtttttttgaggtatacaccagcsattgtttacatgagacttattca

SEQ ID NO: 1052 - DNA, 47 bp, Homo Sapiens
  allele 24: 12-897-115 : polymorphic base T or C
cctactctccaagagatgactacyatgtatagttgtgcaggttgtaa

SEQ ID NO: 1053 - DNA, 47 bp, Homo Sapiens
  allele 24: 12-897-225 : polymorphic base G or A
gtgaccattttaagtctcttaaartactttcatccgtaatttctgtt

SEQ ID NO: 1054 - DNA, 47 bp, Homo Sapiens
  allele 24: 12-898-49 : polymorphic base G or A
  misc_feature 7,18: n=a, g, c or t
aaattantcccatatgtnactttractaaatgagattaagttaatat

SEQ ID NO: 1055 - DNA, 47 bp, Homo Sapiens
  allele 24: 12-164-119 : polymorphic base T or G
tggagaatggactggagtctgtgkgtgtggggacagtgccaatgaga

SEQ ID NO: 1056 - DNA, 47 bp, Homo Sapiens
  allele 24: 12-168-84 : polymorphic base C or A
tggccatgcccatggcagacgggmgagaattcaacctgcgacgtggt

SEQ ID NO: 1057 - DNA, 47 bp, Homo Sapiens
  allele 24: 12-168-365 : polymorphic base C or G
acctggataccctcatgttcaaawgtctctgagggaccacagagacc

SEQ ID NO: 1058 - DNA, 47 bp, Homo Sapiens
  allele 24: 12-170-299 : polymorphic base G or A
cgggcccaccggagcaaatggctrgagagttacctgctgcacctgga

SEQ ID NO: 1059 - DNA, 47 bp, Homo Sapiens
  allele 24: 12-171-360 : polymorphic base C or T
gaaaggcttgcaggaggaggtggyattctatctgggagctctagggt

SEQ ID NO: 1060 - DNA, 47 bp, Homo Sapiens
  allele 24: 12-173-59 : polymorphic base A or G
tactcctcacagcatctctatgargagaaggagggttgtgcccactt

SEQ ID NO: 1061 - DNA, 47 bp, Homo Sapiens
  allele 24: 12-175-214 : polymorphic base A or G
ggcaggggcgttgtggcttcccargagctgcctccacaccttacatc

SEQ ID NO: 1062 - DNA, 47 bp, Homo Sapiens
  allele 24: 12-177-183 : polymorphic base C or G
gaccttgtcaggaagaggaggctwggctttatgctaagtgccctggg

SEQ ID NO: 1063 - DNA, 47 bp, Homo Sapiens
  allele 24: 12-177-366 : polymorphic base C or A
gagttgagatcaagatgagagatmgcagctttgtaaagaactagagg

SEQ ID NO: 1064 - DNA, 47 bp, Homo Sapiens
  allele 24: 10-128-45 : polymorphic base C or T
ttcttttttattgtttctgtaatygtattcttgctgttccaaattgt

SEQ ID NO: 1065 - DNA, 47 bp, Homo Sapiens
  allele 24: 10-128-63 : polymorphic base A or G
gtaattgtattcttgctgttccarattgtttactgaataagtttgaa

SEQ ID NO: 1066 - DNA, 47 bp, Homo Sapiens
  allele 24: 10-123-177 : polymorphic base A or G
tggcccctgagttctgcagcctcraggaaggcctgccctatctggac

SEQ ID NO: 1067 - DNA, 47 bp, Homo Sapiens
  allele 24: 10-123-402 : polymorphic base A or G
tttgtatccccatggcacctcagrtatctggcccgctttcctacagg

SEQ ID NO: 1068 - DNA, 47 bp, Homo Sapiens
  allele 24: 10-120-137 : polymorphic base A or G
accctgagcactggccaagcccgragaccttcaaccctgaaaggtga

SEQ ID NO: 1069 - DNA, 47 bp, Homo Sapiens
  allele 24: 10-120-141 : polymorphic base A or C
tgagcactggccaagcccggagamcttcaaccctgaaaggtgagtac

SEQ ID NO: 1070 - DNA, 47 bp, Homo Sapiens
  allele 24: 10-179-39 : polymorphic base C or T
atgatcccctccatctctctgtcyactttagtcagataagctcaaag

SEQ ID NO: 1071 - DNA, 47 bp, Homo Sapiens
  allele 24: 10-180-65 : polymorphic base G or C
gctccaacagccagacactcagasaggtcctcagacccagcaactaa

SEQ ID NO: 1072 - DNA, 47 bp, Homo Sapiens
  allele 24: 10-179-257 : polymorphic base G or T
gtcctcaaagcagccagcattttkatcaggctggcgtctggtcctgt

SEQ ID NO: 1073 - DNA, 47 bp, Homo Sapiens
  allele 24: 10-43-124 : polymorphic base A or G
taaggacgacgcctggttctgcarctggatctcygtgtagggccccg

SEQ ID NO: 1074 - DNA, 47 bp, Homo Sapiens
  allele 24: 10-43-134 : polymorphic base C or T
gcctggttctgcaactggatctcygtgtagggccccggagccgggga

SEQ ID NO: 1075 - DNA, 47 bp, Homo Sapiens
  allele 24: 10-43-193 : polymorphic base G or T
cccttgttaccgctgggtggaggkcaacggcgtcctgagcctgcctg

SEQ ID NO: 1076 - DNA, 47 bp, Homo Sapiens
  allele 24: 10-43-195 : polymorphic base A or G
cttgttaccgctgggtggaggkcracggcgtcctgagcctgcctgaa

SEQ ID NO: 1077 - DNA, 47 bp, Homo Sapiens
  allele 24: 10-43-233 : polymorphic base C or T
ctgcctgaaggcaccagtaagcgyggggctgvgggtgtcaggaggcc

SEQ ID NO: 1078 - DNA, 47 bp, Homo Sapiens
  allele 24: 10-43-138 : polymorphic base C or T
ggttctgcaactggatctcygtgyagggccccggagccggggacgag

SEQ ID NO: 1079 - DNA, 47 bp, Homo Sapiens
  allele 24: 10-46-372 : polymorphic base C or T
gaatgatgctcaaaccctttgccycatcctgccctgaaggctggccg

SEQ ID NO: 1080 - DNA, 47 bp, Homo Sapiens
  allele 24: 10-46-36 : polymorphic base A or T
tgtaccggtgagccctcctccccwgaccccacgtgagctgctgatgc

SEQ ID NO: 1081 - DNA, 47 bp, Homo Sapiens
  allele 24: 10-47-103 : polymorphic base A or C
tggagtctcaaaatatgctcaaamcctttgccccaaccttccttgaa

SEQ ID NO: 1082 - DNA, 47 bp, Homo Sapiens
  allele 24: 10-47-125 : polymorphic base A or T
accctttgccccaaccttccttgwagcctggccgacctcgctatcaa

SEQ ID NO: 1083 - DNA, 47 bp, Homo Sapiens
  allele 24: 10-48-184 : polymorphic base C or T
caccttcctgctcgcctagtgttycctccaggcatggaggaactgca

SEQ ID NO: 1084 - DNA, 47 bp, Homo Sapiens
  allele 24: 10-48-381 : polymorphic base C or T
ggtcctgagggaccctggagaagytcagctgctcggcctccttccta

SEQ ID NO: 1085 - DNA, 47 bp, Homo Sapiens
  allele 24: 10-49-33 : polymorphic base C or T
tggtataaagtagatgatggagaygagttagctccactctcttcccc

SEQ ID NO: 1086 - DNA, 47 bp, Homo Sapiens
  allele 24: 10-39-148 : polymorphic base A or G
atcgtgagtctccactataagacrgacgtggctgtgaaagacgaccc

SEQ ID NO: 1087 - DNA, 47 bp, Homo Sapiens
  allele 24: 10-40-222 : polymorphic base A or G
gagtgagggaggggtctgtgtgcrggtggaccacggggctcgcgtgc

SEQ ID NO: 1088 - DNA, 47 bp, Homo Sapiens
  allele 24: 10-40-252 : polymorphic base C or T
gaccacggggctcgcgtgcttggyaggcactgactctggatccctgc

SEQ ID NO: 1089 - DNA, 47 bp, Homo Sapiens
  allele 24: 10-42-354 : polymorphic base C or T
caagccacaagctgaccccttcgyggttatagccctgccctcccaag

SEQ ID NO: 1090 - DNA, 47 bp, Homo Sapiens
  allele 24: 10-154-42 : polymorphic base C or T
cttttgtttacattgcctgataayttgtttccctttgtctcccccaa

SEQ ID NO: 1091 - DNA, 47 bp, Homo Sapiens
  allele 24: 10-154-156 : polymorphic base C or T
aaaccctgacactgtgccgtctcyaggggaaacaaaagtgagagtcc

SEQ ID NO: 1092 - DNA, 47 bp, Homo Sapiens
  allele 24: 10-154-226 : polymorphic base A or G
aggacgggctcacattagtggggratacacacatacaaatgctcaca

SEQ ID NO: 1093 - DNA, 47 bp, Homo Sapiens
  allele 24: 12-776-259 : polymorphic base A or G
tgaggtggcgaggtggggtgactrggcctgccagccaaattctggaa

SEQ ID NO: 1094 - DNA, 47 bp, Homo Sapiens
  allele 24: 10-384-109 : polymorphic base C or T
cagaacaaaggctcaggagaccaygcatggcctgattgcctgttctc

SEQ ID NO: 1095 - DNA, 47 bp, Homo Sapiens
  allele 24: 12-296-388 : polymorphic base A or G
ctttccacagtgtatggcctgtcrctgctggaaagtcaccaaggcac

SEQ ID NO: 1096 - DNA, 47 bp, Homo Sapiens
  allele 24: 10-388-379 : polymorphic base C or T
aggcccatctggcctacagcagcygcttccttttcctggcagcagtg

SEQ ID NO: 1097 - DNA, 47 bp, Homo Sapiens
  allele 24: 10-389-116 : polymorphic base A or G
tccccaggcctgatttttggtccrtctgctgagcctgatttggacac

SEQ ID NO: 1098 - DNA, 47 bp, Homo Sapiens
  allele 24: 10-389-349 : polymorphic base C or T
cctttctgagcagctcagtcctcygcgatccagggctcctgggtggc

SEQ ID NO: 1099 - DNA, 47 bp, Homo Sapiens
  allele 24: 10-391-94 : polymorphic base A or G
  misc_feature 43: n=a, g, c or t
ctccctgcgcccagcatcatcctrtagggcaggcctgggtggnggag

SEQ ID NO: 1100 - DNA, 47 bp, Homo Sapiens
  allele 24: 12-277-147 : polymorphic base A or T
ggcacataatgaagtatacccacwgctaaaatcctaaaaattctgga

SEQ ID NO: 1101 - DNA, 47 bp, Homo Sapiens
  allele 24: 12-278-413 : polymorphic base A or G
ggagagatgttctcagagtcagtratgcccctaaaggaagaaaacag

SEQ ID NO: 1102 - DNA, 47 bp, Homo Sapiens
  allele 24: 12-288-190 : polymorphic base G or A
ctttaagaaataaatttgataatrcaagcttttattttgttttcttg

SEQ ID NO: 1103 - DNA, 47 bp, Homo Sapiens
  allele 24: 12-289-35 : polymorphic base A or G
cacctaacctctttcttcttagtraactgacactcgggtcggtctct

SEQ ID NO: 1104 - DNA, 47 bp, Homo Sapiens
  allele 24: 12-296-119 : polymorphic base A or G
cacataaagcactcggcatgggcrgggcatctgagggaagcctgaac

SEQ ID NO: 1105 - DNA, 47 bp, Homo Sapiens
  allele 24: 12-297-291 : polymorphic base C or T
ccccctcctgctgtggaagtcccygtcagatggcagatggagtcctt

SEQ ID NO: 1106 - DNA, 47 bp, Homo Sapiens
  allele 24: 12-298-105 : polymorphic base G or A
acatacataaagtatatcaaggtrgaagtgtgacaccactctgccct

SEQ ID NO: 1107 - DNA, 47 bp, Homo Sapiens
  allele 24: 12-300-126 : polymorphic base A or G
cctgagctaagtgcagtcagcagrcgttgccctctgagcagcacagc

SEQ ID NO: 1108 - DNA, 47 bp, Homo Sapiens
  allele 24: 12-300-410 : polymorphic base A or C
aagacagattcatgggcgaaagcmtacagatttctttaatacaagtt

SEQ ID NO: 1109 - DNA, 47 bp, Homo Sapiens
  allele 24: 12-301-379 : polymorphic base A or T
aatttttgtattcttataagcaawgtgaaaacccttgtatgtgaaat

SEQ ID NO: 1110 - DNA, 47 bp, Homo Sapiens
  allele 24: 12-302-264 : polymorphic base G or A
ttatattccttttcatgactggaragtctgtcatttggcaacccgca

SEQ ID NO: 1111 - DNA, 47 bp, Homo Sapiens
  allele 24: 12-309-405 : polymorphic base G or A
ggaggcaatcactccctggcgccraggttctctactgcaacatctag

SEQ ID NO: 1112 - DNA, 47 bp, Homo Sapiens
  allele 24: 12-310-105 : polymorphic base G or C
tctacagggccagcatggcatagsggggaggtgtgcatgcgttcctg

SEQ ID NO: 1113 - DNA, 47 bp, Homo Sapiens
  allele 24: 12-314-453 : polymorphic base A or T
ggagggatcagtgtctgctcccawgaggatgccctctgtgctgtgtc

SEQ ID NO: 1114 - DNA, 47 bp, Homo Sapiens
  allele 24: 12-316-292 : polymorphic base C or T
  misc_feature 47: n=a, g, c or t
acagaatggtgtcctctgggtgcytgcatttcttacatgatggctgn

SEQ ID NO: 1115 - DNA, 47 bp, Homo Sapiens
  allele 24: 10-281-314 : polymorphic base G or T
cacatccagagggcaaaattactkttgaaatatttcagaattttgag

SEQ ID NO: 1116 - DNA, 47 bp, Homo Sapiens
  allele 24: 10-268-381 : polymorphic base C or T
tataacactgtgttgatccacacygttcactgttctatgtaaggtag

SEQ ID NO: 1117 - DNA, 47 bp, Homo Sapiens
  allele 24: 12-54-297 : polymorphic base C or T
acttacaagtttaaattttttttygacaggaaagggcattctattgt

SEQ ID NO: 1118 - DNA, 47 bp, Homo Sapiens
  allele 24: 10-276-407 : polymorphic base C or T
attagctttatattaattttctcycagtatgatcacaaaatatgtca

SEQ ID NO: 1119 - DNA, 47 bp, Homo Sapiens
  allele 24: 12-44-50 : polymorphic base T or C
cagaagttggtctgtggatggcaytgccatacccgactgacattatt

SEQ ID NO: 1120 - DNA, 47 bp, Homo Sapiens
  allele 24: 12-44-67 : polymorphic base T or C
cagcgtgaactatcagccagaagytggtctgtggatggcactgccat

SEQ ID NO: 1121 - DNA, 47 bp, Homo Sapiens
  allele 24: 12-45-145 : polymorphic base A or G
agtgcttcttaaagggaggccagragaccacctttgtcagggtggcc

SEQ ID NO: 1122 - DNA, 47 bp, Homo Sapiens
  allele 24: 12-45-166 : polymorphic base A or G
agaagaccacctttgtcagggtgrcctgtggttattttattcttacg

SEQ ID NO: 1123 - DNA, 47 bp, Homo Sapiens
  allele 24: 12-45-305 : polymorphic base C or T
tttcaaaagtacctttcacatccycgtgatctcgtacactaaagctt

SEQ ID NO: 1124 - DNA, 47 bp, Homo Sapiens
  allele 24: 12-46-92 : polymorphic base A or G
aagtgctttaaatgcattcttgtrtctaatccttacagtaaccctgc

SEQ ID NO: 1125 - DNA, 47 bp, Homo Sapiens
  allele 24: 12-47-132 : polymorphic base C or T
tccccttctcagcattaaagatayagtcaaggggttagaaaacaggt

SEQ ID NO: 1126 - DNA, 47 bp, Homo Sapiens
  allele 24: 12-47-61 : polymorphic base C or T
gtgcagatgaatgggcagcttccygggtaggtgtgcaggtctggtaa

SEQ ID NO: 1127 - DNA, 47 bp, Homo Sapiens
  allele 24: 12-48-100 : polymorphic base A or G
ctcaatctccatgttggaaatacraatttgttgtaagtgaccaagac

SEQ ID NO: 1128 - DNA, 47 bp, Homo Sapiens
  allele 24: 12-48-323 : polymorphic base A or G
agatggccaccccatctctagttrtggtgtctgcattccagccagta

SEQ ID NO: 1129 - DNA, 47 bp, Homo Sapiens
  allele 24: 12-48-369 : polymorphic base C or T
aagaataggaagagaagacaatcytaccggctagaccttagtctcat

SEQ ID NO: 1130 - DNA, 47 bp, Homo Sapiens
  allele 24: 12-48-37 : polymorphic base C or T
ccagttcggaatccttatcctaaytgcttttcacaacacattccagc

SEQ ID NO: 1131 - DNA, 47 bp, Homo Sapiens
  allele 24: 12-49-131 : polymorphic base T or C
agacttgtctctttccctccaccycacatttgtacacagactgccac

SEQ ID NO: 1132 - DNA, 47 bp, Homo Sapiens
  allele 24: 12-49-53 : polymorphic base G or A
tgtacttgaagtraccagcaaacrttatcttcaagccttaacctctt

SEQ ID NO: 1133 - DNA, 47 bp, Homo Sapiens
  allele 24: 12-49-64 : polymorphic base G or A
caggaaggggttgtacttgaagtraccagcaaacgttatcttcaagc

SEQ ID NO: 1134 - DNA, 47 bp, Homo Sapiens
  allele 24: 12-51-234 : polymorphic base T or C
agaaacttggattaagtggtacaygaatatggttagaaaaattgcat

SEQ ID NO: 1135 - DNA, 47 bp, Homo Sapiens
  allele 24: 12-51-253 : polymorphic base C or A
acattcaagcctgcctagaagaamcttggattaagtggtacaygaat

SEQ ID NO: 1136 - DNA, 47 bp, Homo Sapiens
  allele 24: 12-51-370 : polymorphic base G or A
agaggagaaagtcgatcagagatrcttactcctatgaactttaactt

SEQ ID NO: 1137 - DNA, 47 bp, Homo Sapiens
  allele 24: 12-52-400 : polymorphic base G or A
ctccaaggaatagtttgaaaattrccattcattggagtaaagcttgg

SEQ ID NO: 1138 - DNA, 47 bp, Homo Sapiens
  allele 24: 12-57-192 : polymorphic base G or A
aggtccaaggctggcagtgactaragtaaaagggcagctggaaggtt

SEQ ID NO: 1139 - DNA, 47 bp, Homo Sapiens
  allele 24: 12-57-221 : polymorphic base G or A
tggagggatgaagagactgactgraggtcaggtccaaggctggcagt

SEQ ID NO: 1140 - DNA, 47 bp, Homo Sapiens
  allele 24: 12-57-510 : polymorphic base C or A
tgggtgaacagatatgacagtttmttttaattttaaacagggtcttg

SEQ ID NO: 1141 - DNA, 47 bp, Homo Sapiens
  allele 24: 10-1-139 : polymorphic base G or T
ccggtggcagcatccccgtggctkctcctgctggtggtcggggcctc

SEQ ID NO: 1142 - DNA, 47 bp, Homo Sapiens
  allele 24: 10-1-212 : polymorphic base G or T
ggacctatgccttctatcacaackgccgccgcctccggtgtttcccg

SEQ ID NO: 1143 - DNA, 47 bp, Homo Sapiens
  allele 24: 10-1-241 : polymorphic base A or C
cgcctccggtgtttcccgcagccmcggaaacagaactggttcttggg

SEQ ID NO: 1144 - DNA, 47 bp, Homo Sapiens
  allele 24: 10-9-143 : polymorphic base A or G
cttgtgccaccctgacatcgtccratctgtcatcaatacctcaggta

SEQ ID NO: 1145 - DNA, 47 bp, Homo Sapiens
  allele 24: 10-9-185 : polymorphic base C or T
aggtactcctgcagagcttgtggyggtgggcacaggagaacattgga

SEQ ID NO: 1146 - DNA, 47 bp, Homo Sapiens
  allele 24: 10-9-264 : polymorphic base G or C
gcagctcttgtagtactcagcccsttccttcctgcttctctctcagc

SEQ ID NO: 1147 - DNA, 45 bp, Homo Sapiens
  allele 22: 10-11-22 : polymorphic base C or T
tgttgttgcagcctagtccggycccctttatgccccccaccctcc

SEQ ID NO: 1148 - DNA, 47 bp, Homo Sapiens
  allele 24: 10-13-152 : polymorphic base C or T
gagacaccaccgtcgcttgctgaygcctgccttccatttcaacatcc

SEQ ID NO: 1149 - DNA, 47 bp, Homo Sapiens
  allele 24: 10-13-256 : polymorphic base C or T
tgaactcagcatcccagctgcagycttggggtggagggatcacatac

SEQ ID NO: 1150 - DNA, 47 bp, Homo Sapiens
  allele 24: 10-13-282 : polymorphic base C or T
tggggtggagggatcacatacaaytgggtctggaatgttggctctcc

SEQ ID NO: 1151 - DNA, 47 bp, Homo Sapiens
  allele 24: 10-15-281 : polymorphic base G or T
gggaacatgggatggagtgggggkgtgggtgtggggagagcaaagcc

SEQ ID NO: 1152 - DNA, 47 bp, Homo Sapiens
  allele 24: 10-17-142 : polymorphic base C or T
tgtacttcctcactccctgtggayggcgcttccacagggcctgcaga

SEQ ID NO: 1153 - DNA, 47 bp, Homo Sapiens
  allele 24: 10-18-302 : polymorphic base C or T
ggtcaaatgtcagattgaaggacyggacttgatacagagggcactaa

SEQ ID NO: 1154 - DNA, 47 bp, Homo Sapiens
  allele 24: 10-23-331 : polymorphic base A or G
tcttctccccaggtgggggaaaargggaggatctttttgatgattct

SEQ ID NO: 1155 - DNA, 47 bp, Homo Sapiens
  allele 24: 10-25-152 : polymorphic base C or T
cagcaggagggccgtgtatgctcyctggataattgttgggtgtttcc

SEQ ID NO: 1156 - DNA, 47 bp, Homo Sapiens
  allele 24: 10-25-258 : polymorphic base C or T
ttgcatcccccaatccctacattygcccgcggctgcacccaggacgt

SEQ ID NO: 1157 - DNA, 47 bp, Homo Sapiens
  allele 24: 10-3-103 : polymorphic base C or T
ctccatggcaggggaggagggtcytgggcagggcggtggtcccagca

SEQ ID NO: 1158 - DNA, 47 bp, Homo Sapiens
  allele 24: 10-3-144 : polymorphic base C or T
ccagcaggcagctcggaccttgtycttactgtcctctcctgcacgac

SEQ ID NO: 1159 - DNA, 47 bp, Homo Sapiens
  allele 24: 10-3-275 : polymorphic base G or T
ttctccatcccccgggcctggtckggggaggggtcttgtcccggaaa

SEQ ID NO: 1160 - DNA, 47 bp, Homo Sapiens
  allele 24: 10-5-227 : polymorphic base A or C
tatgaccccttccgcttcgacccmgaaaacgcccagaagaggtcacc

SEQ ID NO: 1161 - DNA, 47 bp, Homo Sapiens
  allele 24: 10-7-155 : polymorphic base C or T
tgggtgcagtcagaccttccaccytggcccccaggaactgcatcggg

SEQ ID NO: 1162 - DNA, 47 bp, Homo Sapiens
  allele 24: 10-7-383 : polymorphic base C or T
tgcatcacctacctttgcaccaaytaccttttcagatttccggtaat

SEQ ID NO: 1163 - DNA, 47 bp, Homo Sapiens
  allele 24: 10-7-98 : polymorphic base G or C
gtggggttgggggttccgggcctsgttcctggcgcagtggggccggg

SEQ ID NO: 1164 - DNA, 47 bp, Homo Sapiens
  allele 24: 12-561-270 : polymorphic base C or T
gcatgcaaacctgttgatgacccytccttgggtcatcatgaggacta

SEQ ID NO: 1165 - DNA, 47 bp, Homo Sapiens
  allele 24: 12-563-87 : polymorphic base C or T
tctgctcaagggatccaatctgayggtgggtgtatagagtaggcaac

SEQ ID NO: 1166 - DNA, 47 bp, Homo Sapiens
  allele 24: 12-564-64 : polymorphic base G or T
tgtaggtaattagacttttctttkaggtgcttataagcatttcttgt

SEQ ID NO: 1167 - DNA, 47 bp, Homo Sapiens
  allele 24: 12-564-214 : polymorphic base C or T
ttcttcagatgaagaacagttttyttcttctatttaattattttttt

SEQ ID NO: 1168 - DNA, 47 bp, Homo Sapiens
  allele 24: 12-568-207 : polymorphic base G or T
gatatatacacacatacctatttktttgtctcatacacattgaaatt

SEQ ID NO: 1169 - DNA, 47 bp, Homo Sapiens
  allele 24: 12-568-365 : polymorphic base G or T
tacttgtttgatcaaaccttctgkatgtaaccatcttctatcaccac

SEQ ID NO: 1170 - DNA, 47 bp, Homo Sapiens
  allele 24: 12-568-367 : polymorphic base G or T
cttgtttgatcaaaccttctgtakgtaaccatcttctatcaccacca

SEQ ID NO: 1171 - DNA, 47 bp, Homo Sapiens
  allele 24: 12-571-337 : polymorphic base G or C
gaggatcttgggagccgacgtccsgacgcctcccgcccccgcagttc

SEQ ID NO: 1172 - DNA, 47 bp, Homo Sapiens
  allele 24: 12-573-378 : polymorphic base A or G
aattacatattataaatacaaatrtataaactataaactgaattacg

SEQ ID NO: 1173 - DNA, 47 bp, Homo Sapiens; identical to SEQ ID NO: 1171
  allele 24: 10-294-256 : polymorphic base G or C

SEQ ID NO: 1174 - DNA, 47 bp, Homo Sapiens
  allele 24: 10-294-304 : polymorphic base G or C
ttggagagcttggagccgcgcgcsggagggaataggaaagcttggtt

SEQ ID NO: 1175 - DNA, 47 bp, Homo Sapiens
  allele 24: 10-295-201 : polymorphic base G or T
atagtgactttgagttgaagacakctgagctcccacccttaaaaaat

SEQ ID NO: 1176 - DNA, 47 bp, Homo Sapiens
  allele 24: 10-296-80 : polymorphic base A or G
agtgagcatggtacctcatgggtrgtttctcaacccttgtccctgtc

SEQ ID NO: 1177 - DNA, 47 bp, Homo Sapiens
  allele 24: 10-296-373 : polymorphic base A or G
ttctcccagccagtatcagtgatragattcatgcacgctcgtctttt

SEQ ID NO: 1178 - DNA, 47 bp, Homo Sapiens
  allele 24: 10-298-122 : polymorphic base C or T
ttttgtcaacactaaccacacagyatcctgactcccttgaaagggaa

SEQ ID NO: 1179 - DNA, 47 bp, Homo Sapiens
  allele 24: 10-298-158 : polymorphic base A or G
ttgaaagggaagacatgtcacatrccttaatgccttaatgtgcttta

SEQ ID NO: 1180 - DNA, 47 bp, Homo Sapiens
  allele 24: 10-300-49 : polymorphic base A or G
tgatttcacctatgggatctgttrgcccattatggtattccttttat

SEQ ID NO: 1181 - DNA, 47 bp, Homo Sapiens
  allele 24: 10-300-185 : polymorphic base C or T
atggtttccttttttttttttttyctacttagggctgcaaagttgtt

SEQ ID NO: 1182 - DNA, 47 bp, Homo Sapiens
  allele 24: 10-10-328 : polymorphic base A or G
ctctgtgctgcctccagcgggtcrcgtgcccatgtgcagacaggagg

SEQ ID NO: 1183 - DNA, 47 bp, Homo Sapiens
  allele 24: 10-12-52 : polymorphic base C or T
gagcctccccccacccccaaagtycctccttcacctgcctccatggc

SEQ ID NO: 1184 - DNA, 47 bp, Homo Sapiens
  allele 24: 10-14-46 : polymorphic base C or T
agccctggctgggtgagtatctgyaggtgaacagggttgggaacaac

SEQ ID NO: 1185 - DNA, 47 bp, Homo Sapiens
  allele 24: 10-19-358 : polymorphic base A or G
tcatgtgaaatgtcagatgaaagratttgaacttgayhcagagggca

SEQ ID NO: 1186 - DNA, 47 bp, Homo Sapiens
  allele 24: 10-20-111 : polymorphic base A or C
cctggtgcacgacttcacagatgmcgtcatccaggagcggcgccgca

SEQ ID NO: 1187 - DNA, 47 bp, Homo Sapiens
  allele 24: 10-20-274 : polymorphic base A or G
gaagtagaagggagcttcatgtgraatgtcagatgaaagaatttgaa

SEQ ID NO: 1188 - DNA, 47 bp, Homo Sapiens
  allele 24: 10-24-90 : polymorphic base A or C
ggtcctcaatgcaaggttgctgtmcaccctcgggtgctgaagcagcc

SEQ ID NO: 1189 - DNA, 47 bp, Homo Sapiens
  allele 24: 10-24-204 : polymorphic base A or G
ctgtaccaccttgcaaagcacccrgaataccaggagcgctgtcggca

SEQ ID NO: 1190 - DNA, 47 bp, Homo Sapiens
  allele 24: 10-24-221 : polymorphic base G or T
gcacccggaataccaggagcgctktcggcaggaggtdcaagagcttc

SEQ ID NO: 1191 - DNA, 47 bp, Homo Sapiens
  allele 24: 10-24-234 : polymorphic base A or G
caggagcgctgtcggcaggaggtrcaagagcttctgaaggaccgtga

SEQ ID NO: 1192 - DNA, 47 bp, Homo Sapiens
  allele 24: 10-24-288 : polymorphic base A or G
gagattgaatggtgagtgcaggtrctggtgccctgttcctgagcctg

SEQ ID NO: 1193 - DNA, 47 bp, Homo Sapiens
  allele 24: 10-24-311 : polymorphic base G or C
gctggtgccctgttcctgagcctstctcattggctctgttccccagg

SEQ ID NO: 1194 - DNA, 47 bp, Homo Sapiens
  allele 24: 10-26-289 : polymorphic base G or C
gggcccctcaggcagggagccttstcctgactgcccccttctctccc

SEQ ID NO: 1195 - DNA, 47 bp, Homo Sapiens
  allele 24: 10-8-39 : polymorphic base A or C
ggttgggtgtcccaggccaggttmccggcttgatggggccaggatgg

SEQ ID NO: 1196 - DNA, 47 bp, Homo Sapiens
  allele 24: 10-8-120 : polymorphic base A or G
cccctaggaactgcatcgggcagrcgttcgcgatggcggagatgaag

SEQ ID NO: 1197 - DNA, 47 bp, Homo Sapiens
  allele 24: 10-8-154 : polymorphic base G or C
ggcggagatgaaggtggtcctggsgctcacgctgctggcttccgcgt

SEQ ID NO: 1198 - DNA, 47 bp, Homo Sapiens
  allele 24: 10-8-101 : polymorphic base A or T
tcagagttcccacctccctccccwaggaactgcatcgggcagdcgtt

SEQ ID NO: 1199 - DNA, 47 bp, Homo Sapiens
  allele 24: 10-8-86 : polymorphic base C or T
ggctcctgggtgcagtcagagttyccacctccctcccctaggaactg

SEQ ID NO: 1200 - DNA, 47 bp, Homo Sapiens
  allele 24: 10-8-92 : polymorphic base C or T
tgggtgcagtcagagttcccaccyccctcccctaggaactgcatcgg

SEQ ID NO: 1201 - DNA, 47 bp, Homo Sapiens
  allele 24: 10-8-94 : polymorphic base C or T
ggtgcagtcagagttcccacctcyctcccctaggaactgcatcgggc

SEQ ID NO: 1202 - DNA, 47 bp, Homo Sapiens
  allele 24: 12-61-472 : polymorphic base C or T
gggagaggagacaaagagaaagayagcttacaccattatttctgcat

SEQ ID NO: 1203 - DNA, 47 bp, Homo Sapiens
  allele 24: 12-63-402 : polymorphic base A or G
ctggacaaggccagtttcaatagrgctgtgagggcagaaatcagacc

SEQ ID NO: 1204 - DNA, 47 bp, Homo Sapiens
  allele 24: 12-63-74 : polymorphic base A or G
aatagttctaaaacgcaaacatgrttcaatcagtctcctgcttaaag

SEQ ID NO: 1205 - DNA, 47 bp, Homo Sapiens
  allele 24: 12-64-271 : polymorphic base C or T
gggcaggtttcttgacctgtttcytcttttgtataaaatgtgggtat

SEQ ID NO: 1206 - DNA, 47 bp, Homo Sapiens
  allele 24: 12-65-98 : polymorphic base C or T
gcttcctgctctgtgcacactcayaggcgcaaccagatacttgggaa

SEQ ID NO: 1207 - DNA, 47 bp, Homo Sapiens
  allele 24: 12-70-147 : polymorphic base A or C
aagagcccatgaccacagggaagmcatgaagatactgaactgggaga

SEQ ID NO: 1208 - DNA, 47 bp, Homo Sapiens
  allele 24: 12-70-397 : polymorphic base C or T
gttggtcaaccactttgtgagaaygtagtagtggacattcagagacc

SEQ ID NO: 1209 - DNA, 47 bp, Homo Sapiens
  allele 24: 12-71-320 : polymorphic base A or G
ctcaggtatgaggaccagcaagaractggctttattcaggtttacag

SEQ ID NO: 1210 - DNA, 47 bp, Homo Sapiens
  allele 24: 12-73-150 : polymorphic base C or T
gaagttctcaggttcatcatattytgtcttctcctttaggcattcca

SEQ ID NO: 1211 - DNA, 47 bp, Homo Sapiens
  allele 24: 12-73-49 : polymorphic base A or G
caaggcatgacatctgctttcatrgagctaacattcttgtggagttg

SEQ ID NO: 1212 - DNA, 47 bp, Homo Sapiens
  allele 24: 12-73-56 : polymorphic base A or T
tgacatctgctttcatagagctawcattcttgtggagttgggccttc

SEQ ID NO: 1213 - DNA, 47 bp, Homo Sapiens
  allele 24: 12-74-38 : polymorphic base G or A
aacatacacactggactcaagcaraagttcaggaaactataccctta

SEQ ID NO: 1214 - DNA, 47 bp, Homo Sapiens
  allele 24: 12-76-238 : polymorphic base G or T
agggacacaaagaaacatagactkcccccatcccagatgattccgag

SEQ ID NO: 1215 - DNA, 47 bp, Homo Sapiens
  allele 24: 12-77-217 : polymorphic base C or T
gattatgaagaattaatttaaggyagacagactggaggtcaggtgag

SEQ ID NO: 1216 - DNA, 47 bp, Homo Sapiens
  allele 24: 12-77-478 : polymorphic base A or G
attggtggagtgagggtaagacarctgggactgagtagaggttttag

SEQ ID NO: 1217 - DNA, 47 bp, Homo Sapiens
  allele 24: 12-80-114 : polymorphic base T or C
aaacttccccagttttgcgctcayctctgcaatgctgtgattggcta

SEQ ID NO: 1218 - DNA, 47 bp, Homo Sapiens
  allele 24: 12-80-233 : polymorphic base G or A
ttacgcaggttgtctggattttgrgaaagccgctttatttctgccct

SEQ ID NO: 1219 - DNA, 47 bp, Homo Sapiens
  allele 24: 12-82-250 : polymorphic base A or T
cttcttaatgaagtgctaggaaawaaatctaaagtattatttttgct

SEQ ID NO: 1220 - DNA, 47 bp, Homo Sapiens
  allele 24: 10-176-85 : polymorphic base C or T
tccccactctgagtttcctgtccyaaagtcctaaggaagtttccaga

SEQ ID NO: 1221 - DNA, 47 bp, Homo Sapiens
  allele 24: 10-176-51 : polymorphic base C or T
gctctgtcctcagggtggcccgcygtagtccccctccccactctgag

SEQ ID NO: 1222 - DNA, 47 bp, Homo Sapiens
  allele 24: 10-176-207 : polymorphic base G or T
tgtccagaccacagggcctgagtktggggagggcagccgtctaggaa

SEQ ID NO: 1223 - DNA, 47 bp, Homo Sapiens
  allele 24: 10-176-397 : polymorphic base A or C
caggtttcctcctggcagggtggmccttgtgcatggaacccctacaa

SEQ ID NO: 1224 - DNA, 47 bp, Homo Sapiens
  allele 24: 10-177-219 : polymorphic base A or C
ccaggaacagcctggatggggacmgggaacagataaggtgggtggag

SEQ ID NO: 1225 - DNA, 47 bp, Homo Sapiens
  allele 19: 12-214-85 : deletion  CCTAT
gagcctcagcctctccaccctatcctatttctccccaatcagcctcc

SEQ ID NO: 1226 - DNA, 47 bp, Homo Sapiens
  allele 24: 12-215-272 : deletion  T
taaggtctaatttcattttttttaatgtttatgttcagctcttttgt

SEQ ID NO: 1227 - DNA, 47 bp, Homo Sapiens
  allele 24: 12-221-163 : variant  GTCCTCA or T
atcagcaaaactgttgagctacagtcctcattgggttctgtccctct

SEQ ID NO: 1228 - DNA, 47 bp, Homo Sapiens
  allele 24: 12-225-82 : deletion  T
agcttctacattttctttttttttgagactgagtctcactgtgtcgt

SEQ ID NO: 1229 - DNA, 47 bp, Homo Sapiens
  allele 24: 10-234-179 : deletion  AA
atattccaaccttatgttagataaagtctattgattctgggaagttg

SEQ ID NO: 1230 - DNA, 47 bp, Homo Sapiens
  allele 24: 10-235-272 : deletion  T
tttaattgttaaagaatttttttatatataattctgcagctgtgaac

SEQ ID NO: 1231 - DNA, 47 bp, Homo Sapiens
  allele 24: 10-251-342 : variant  GG or C
cttaatgttcatttcctgaatgaggcatgtctttctgtacccccaca

SEQ ID NO: 1232 - DNA, 47 bp, Homo Sapiens
  allele 23: 10-395-367 : deletion  A
ttctcctctttcttaatacttcagctgttcctagtagttcaatttga

SEQ ID NO: 1233 - DNA, 47 bp, Homo Sapiens
  allele 24: 12-730-58 : deletion  ACAA
gttgcaataagtctacataacaaacaatttccatatctcagacattt

SEQ ID NO: 1234 - DNA, 47 bp, Homo Sapiens
  allele 24: 12-735-208 : deletion  AACGATATGTTATATGGCACTTACACTACTTGTGAAAGTATTTACTAGTAGAATGAG
agatcttttaaaatcctaatataaacgatatgttatatggcacttac

SEQ ID NO: 1235 - DNA, 45 bp, Homo Sapiens
  allele 24: 12-739-22 : insertion G
cattactttgtgctaagggtadgagtatagattcttcagaaggaa

SEQ ID NO: 1236 - DNA, 47 bp, Homo Sapiens
  allele 24: 12-540-363 : insertion T
ggactgattcaaatagaattgagtgtgagcagttgatgcaatttgtg

SEQ ID NO: 1237 - DNA, 47 bp, Homo Sapiens
  allele 23: 12-550-206 : deletion  T
tctgaaaaaagatgctcatctttgttttttaattgcttcatagttca

SEQ ID NO: 1238 - DNA, 47 bp, Homo Sapiens
  allele 24: 10-207-410 : insertion C
  misc_feature 23: n=a, g, c or t
cgaaattagtgacccttcccccnaaattaggttgctaaaacagttac

SEQ ID NO: 1239 - DNA, 47 bp, Homo Sapiens
  allele 24: 10-171-254 : deletion  GG
ccctccgccgaagaaagtgaagtgggcccgggaggcggggcgcgcgg

SEQ ID NO: 1240 - DNA, 47 bp, Homo Sapiens
  allele 24: 12-94-110 : deletion  AATT
gactattgtttgtgttcatgtttaattgagttcaaatttaatattta

SEQ ID NO: 1241 - DNA, 47 bp, Homo Sapiens
  allele 24: 12-834-290 : deletion  G
ggaggggagttgattagttaaaggaagtgactctagattgactccag

SEQ ID NO: 1242 - DNA, 47 bp, Homo Sapiens
  allele 24: 10-55-115 : deletion  TTATA
ttttacttgaatttcaacttatattataagaacgaaagtaaagatgt

SEQ ID NO: 1243 - DNA, 47 bp, Homo Sapiens
  allele 24: 12-857-122 : insertion CTCT
aatacaggaactgttaacttccctctctattatcagaagatcaagat

SEQ ID NO: 1244 - DNA, 47 bp, Homo Sapiens
  allele 24: 12-872-175 : deletion  T
agcttatgctgacctactttttttaaggacttgatatgttggtctgg

SEQ ID NO: 1245 - DNA, 47 bp, Homo Sapiens
  allele 24: 12-882-40 : deletion  A
tccctaagcctacttactgtcaaattgacacatggcttaagtgaata

SEQ ID NO: 1246 - DNA, 47 bp, Homo Sapiens; identical to SEQ ID NO: 1245
  allele 21: 12-888-234 : deletion  C

SEQ ID NO: 1247 - DNA, 47 bp, Homo Sapiens; identical to SEQ ID NO: 1228
  allele 24: 12-278-353 : insertion A

SEQ ID NO: 1248 - DNA, 47 bp, Homo Sapiens
  allele 24: 12-283-386 : insertion T
cagcagagccactccacagactaagacctgtgttgccaaggaatcag

SEQ ID NO: 1249 - DNA, 47 bp, Homo Sapiens
  allele 24: 12-44-181 : deletion  C
tactcctaccttggtctgccatactatatagccctaaaatcccagat

SEQ ID NO: 1250 - DNA, 47 bp, Homo Sapiens
  allele 24: 10-370-132 : polymorphic base C or T
ccattatttatactgtatttgttyttcattgattttattctttgcag

SEQ ID NO: 1251 - DNA, 47 bp, Homo Sapiens
  allele 24: 10-370-254 : polymorphic base C or T
tccaaaggtccacgatgggctttyccaacagctccaccttacttctt

SEQ ID NO: 1252 - DNA, 47 bp, Homo Sapiens
  allele 24: 10-485-256 : polymorphic base A or G
aaataaattcatatggttatatgrtatctctggtgtatactgattga

SEQ ID NO: 1253 - DNA, 47 bp, Homo Sapiens
  allele 24: 10-485-257 : polymorphic base C or T
aataaattcatatggttatatgayatctctggtgtatactgattgag

SEQ ID NO: 1254 - DNA, 47 bp, Homo Sapiens
  allele 1: 10-474-320 : deletion  A
cgaggtgcactggcggagacagggaggccgcgcccggcgtgcccact

SEQ ID NO: 1255 - DNA, 47 bp, Homo Sapiens
  allele 24: 10-387-371 : polymorphic base C or T
gcatgggggcctcgctgccaccaygccaccctggacagcacccccta

SEQ ID NO: 1256 - DNA, 47 bp, Homo Sapiens
  allele 24: 12-570-239 : polymorphic base T or C
ggtcgccggctccgagggcgcacytggggcgggatgggggccgggag

SEQ ID NO: 1257 - DNA, 47 bp, Homo Sapiens
  allele 24: 12-570-344 : polymorphic base T or C
tgcgggacaagcttctggaagctytttgcggtggcgttggtgctgtt

SEQ ID NO: 1258 - DNA, 47 bp, Homo Sapiens
  allele 24: 12-570-393 : polymorphic base T or C
cgcctctgcgcaggcgcagtggtycccgcagcttgcgcgcgcactcg

SEQ ID NO: 1259 - DNA, 47 bp, Homo Sapiens
  allele 24: 12-570-421 : polymorphic base T or G
acgagcgcgttcggggagtccggktcagcgcctctgcgcaggcgcag

SEQ ID NO: 1260 - DNA, 47 bp, Homo Sapiens
  allele 24: 12-570-62 : deletion of TG
cgggataatgccttgttttgtttgtgtggtgtggcggtgagggggag

SEQ ID NO: 1261 - DNA, 47 bp, Homo Sapiens
  allele 24: 10-4-144 : polymorphic base A or C
agcctcctgggtaggaagaggggmccctcaggcagggagcmttgtcc

SEQ ID NO: 1262 - DNA, 47 bp, Homo Sapiens
  allele 24: 10-4-161 : polymorphic base A or C
gaggggcccctcaggcagggagcmttgtcctgactgcccccttctct

SEQ ID NO: 1263 - DNA, 47 bp, Homo Sapiens
  allele 24: 10-4-270 : polymorphic base G or C
ggaccctgaggtgcgggccccccstctctgtttttgtccattccaag

SEQ ID NO: 1264 - DNA, 47 bp, Homo Sapiens
  allele 24: 10-4-340 : polymorphic base A or G
tttgatcaggagaatccaacatcrcctccctccaagacacacaccac

SEQ ID NO: 1265 - DNA, 47 bp, Homo Sapiens
  allele 24: 10-4-369 : polymorphic base C or T
ctccaagacacacaccactgtctytccaaggctggcggactgggaga

SEQ ID NO: 1266 - DNA, 47 bp, Homo Sapiens
  allele 24: 10-4-420 : polymorphic base G or T
acccggcaacccttcttggtctckyctccaggtctatgacccctttc

SEQ ID NO: 1267 - DNA, 47 bp, Homo Sapiens
  allele 24: 10-13-396 : deletion of AAT
actaaaaggtggtaggagcatgtaatggactcatgtctctgacactt

SEQ ID NO: 1268 - DNA, 47 bp, Homo Sapiens
  allele 24: 10-509-284 : polymorphic base C or T
tgcttttggaagtaggtatgagayaaactcttttytaggcaaaagta

SEQ ID NO: 1269 - DNA, 47 bp, Homo Sapiens
  allele 24: 10-509-295 : deletion of C
gtaggtatgagacaaactcttttctaggcaaaagtaacccacgaaaa

SEQ ID NO: 1270 - DNA, 47 bp, Homo Sapiens
  allele 24: 10-339-124 : polymorphic base C or T
agcttctaactgctattcctttcytgcccaggtttccctgtctcctt

SEQ ID NO: 1271 - DNA, 47 bp, Homo Sapiens
  allele 24: 10-340-112 : polymorphic base A or C
aatgcggatgcccccacccaccamcaaggaagatgtgacgatggcca

SEQ ID NO: 1272 - DNA, 47 bp, Homo Sapiens
  allele 24: 10-340-130 : polymorphic base A or T
caccaccaaggaagatgtgacgawggccacagtgatggggtcactac

SEQ ID NO: 1273 - DNA, 47 bp, Homo Sapiens
  allele 24: 10-340-238 : polymorphic base A or G
agacatggtgagaggggactctcrggagagggaaatgacagttggaa

SEQ ID NO: 1274 - DNA, 47 bp, Homo Sapiens
  allele 24: 10-342-301 : insertion of A
aaccatttaaaatgcaaaaaaaatccacaaacaaatgtgctttgttt

SEQ ID NO: 1275 - DNA, 47 bp, Homo Sapiens
  allele 24: 10-342-373 : polymorphic base C or T
ctggatttggcccttgaaccctgyactagcctgaggccctgacccta

SEQ ID NO: 1276 - DNA, 47 bp, Homo Sapiens
  allele 21: 10-343-231 : deletion of C
cgaggacatcctgagcctgcccgagggcaccggtgagcaggcggcgt

SEQ ID NO: 1277 - DNA, 47 bp, Homo Sapiens
  allele 24: 10-343-278 : polymorphic base C or T
gtyggggaaggaggcacaaggtcycgggaactgctgcggggctagga

SEQ ID NO: 1278 - DNA, 47 bp, Homo Sapiens
  allele 24: 10-346-141 : polymorphic base A or G
ggctctggagatggccctcaaacrtgtttacaccctcctgagctcct

SEQ ID NO: 1279 - DNA, 46 bp, Homo Sapiens
  allele 23: 10-346-23 : polymorphic base A or G
gtgagaaaaaggctagacctcgragtgaataagggctgggagggcc

SEQ ID NO: 1280 - DNA, 47 bp, Homo Sapiens
  allele 24: 10-346-263 : polymorphic base G or C
tctccataatcccttaatggcccstctggatgactcatcacactcca

SEQ ID NO: 1281 - DNA, 47 bp, Homo Sapiens
  allele 24: 10-346-305 : polymorphic base C or T
ctccacagtcccccgtaactcttygcaagaagagaccttatcatatc

SEQ ID NO: 1282 - DNA, 47 bp, Homo Sapiens
  allele 24: 10-349-216 : deletion of CTG
tgcacgagatccagtatcacttgctgaacackcacctggtggctgag

SEQ ID NO: 1283 - DNA, 47 bp, Homo Sapiens
  allele 24: 10-350-332 : polymorphic base C or T
caagatcaactatgtgtgaatgtyctcactcttaacctatgaacctg

SEQ ID NO: 1284 - DNA, 47 bp, Homo Sapiens
  allele 24: 10-350-72 : polymorphic base C or T
aggaaagcatcaagaggagaaggygccatgctgggtgccaggcccta

SEQ ID NO: 1285 - DNA, 47 bp, Homo Sapiens
  allele 24: 10-507-170 : polymorphic base A or G
gggatcgtccacctcttctaccaragggatgacatagtgaaggggga

SEQ ID NO: 1286 - DNA, 47 bp, Homo Sapiens
  allele 24: 10-507-321 : polymorphic base A or C
ctctgccagggcgccttcccagcmctgcccttctggggacaggaccc

SEQ ID NO: 1287 - DNA, 47 bp, Homo Sapiens
  allele 24: 10-507-353 : polymorphic base C or T
ctggggacaggaccccagcctctyatcacgcctcccttcctccctcc

SEQ ID NO: 1288 - DNA, 47 bp, Homo Sapiens
  allele 24: 10-507-364 : polymorphic base C or T
accccagcctctcatcacgcctcycttcctccctccacacgggaaag

SEQ ID NO: 1289 - DNA, 46 bp, Homo Sapiens
  allele 24: 10-507-405 : polymorphic base C or T
ggaaagcatgtgtatcccattccyacctcctccgcytcaggacaat

SEQ ID NO: 1290 - DNA, 47 bp, Homo Sapiens
  allele 24: 10-508-191 : polymorphic base C or T
actgttttctttcttcactacttycgtggagaggttttttctgggtt

SEQ ID NO: 1291 - DNA, 47 bp, Homo Sapiens
  allele 24: 10-508-245 : polymorphic base C or T
aattttgcttctaattatattctyccaacatagcgcatgtgcttaaa

SEQ ID NO: 1292 - DNA, 46 bp, Homo Sapiens
  allele 21: 10-510-173 : variable motif ATTTA or TTTTTT
tttttatttttatttatttattttttatttttgagatagagtctga

SEQ ID NO: 1293 - DNA, 47 bp, Homo Sapiens
  allele 1: 10-511-337 : insertion of T
taagcaattccatcccgcaccctaacaccccgactggtgttcctggg

SEQ ID NO: 1294 - DNA, 47 bp, Homo Sapiens
  allele 24: 10-512-36 : polymorphic base G or C
accctaacaccccgactggtgttsctgggtccctaacattgtctgta

SEQ ID NO: 1295 - DNA, 47 bp, Homo Sapiens
  allele 24: 10-511-62 : polymorphic base C or T
gatctagacagggacgcgtgcagyaggcttcatctgactgattcctg

SEQ ID NO: 1296 - DNA, 47 bp, Homo Sapiens
  allele 24: 10-512-318 : polymorphic base A or G
catgggccgcgccgggtctagccrcgggacatccccagaccccagca

SEQ ID NO: 1297 - DNA, 47 bp, Homo Sapiens
  allele 24: 10-513-250 : polymorphic base A or G
  misc_feature 36: n=a, g, c or t
ttcgctccaacccgggggctcagrcccacctcgatnccgccttcccg

SEQ ID NO: 1298 - DNA, 47 bp, Homo Sapiens
  allele 24: 10-513-262 : polymorphic base C or T
cgggggctcaggcccacctcgatyccgccttcccgggaggtccagga

SEQ ID NO: 1299 - DNA, 47 bp, Homo Sapiens
  allele 24: 10-513-352 : polymorphic base A or G
cccctttatcatcctgcagctacrctccgaccaggavgcacagccag

SEQ ID NO: 1300 - DNA, 47 bp, Homo Sapiens
  allele 24: 10-513-365 : polymorphic base A or G
ctgcagctacgctccgaccaggargcacagccagtccccacagccgg

SEQ ID NO: 1301 - DNA, 47 bp, Homo Sapiens
  allele 24: 10-517-100 : polymorphic base G or C
ttgcactgaggggcaaatgtgagsctctgggtacaatgcccagtaca

SEQ ID NO: 1302 - DNA, 47 bp, Homo Sapiens
  allele 24: 10-518-125 : polymorphic base G or T
gctgtaatttaatggccgtctcgkctattaacacgctcttctcgggt

SEQ ID NO: 1303 - DNA, 47 bp, Homo Sapiens
  allele 24: 10-518-194 : polymorphic base A or G
gggcctctgcacgtgctctgcgcrctggctgggggtgactccaagga

SEQ ID NO: 1304 - DNA, 47 bp, Homo Sapiens
  allele 24: 10-522-71 : polymorphic base A or G
gatgtaagtgttagaagastaacrctttatggggttcaaactccttg

What is claimed is:

1. A method of determining the frequency in a population of an allele of one or more eicosanoid-related biallelic mark or one or more 12-lipoxygenase-related (12-LO-related) biallelic marker, comprising the steps of:
 (a) genotyping individuals from said population for one or more eicosanoid-related biallelic marker one or more 12-LO-related biallelic marker comprising determining the identity of a nucleotide at said one or more eicosanoid-related biallelic marker or said one or more 12-LO-related biallelic marker in a biological sample; and
 (b) determining the proportional representation of said one or more eicosanoid-related biallelic marker or said one or more 12-LO-related biallelic marker in said population;

wherein said one or more eicosanoid-related biallelic marker or said one or more 12-lipoxygenase-related (12-LO-related) biallelic marker is found in SEQ ID No. 651.

2. The method according to claim 1, wherein step (a) is performed on each individual of said population.

3. The method according to clam 1, wherein step (a) is performed on a single pooled biological sample derived from said population.

4. A method of detecting an association between an allele and a phenotype, comprising the steps of:
 (a) determining the frequency of at least one eicosanoid-related biallelic marker allele or at least one 12-LO-related biallelic marker allele in an affected population according to the method of claim 1;
 (b) determining the frequency of said eicosanoid-related biallelic marker allele or said 12-LO-related biallelic marker allele in a control population according to the method of claim 1; and (c) determining whether a statistically significant association exists between said eicosanoid-related biallelic marker allele or said 12-LO-related biallelic marker allele and said phenotype;

wherein said at least one eicosanoid-related biallelic marker or said at least one 12-lipoxygenase-related (12-LO-related) biallelic marker is found in SEQ ID No. 651.

5. The method according to claim 4, wherein said control population is either a trait negative population or a random population.

6. The method according to claim 4, wherein steps (a) and (b) are preformed on a single pooled biological sample derived from each of said populations.

7. The method according to claim 4, wherein steps (a) and (b) are performed separately on biological samples derived from each individual in said populations.

8. The method according to claim 4, wherein the identity of the nucleotides at all of the biallelic markers described in FIG. 2(A–B) is determined in steps (a) and (b).

9. The method according to claim 1, wherein the identity and proportional representation of more than one eicosanoid-related biallelic marker or more than one 12-LO-related biallelic marker in said population is determined.

10. A method of estimating the frequency of a haplotype for a set of biallelic markers in a population, comprising the steps of:

(a) genotyping each individual in said population for a first biallelic marker, wherein said first biallelic marker is a eicosanoid-related biallelic marker or a 12-LO-related biallelic marker;

(b) genotyping each individual in said population for a second biallelic marker by determining the identity of the nucleotides at said second biallelic marker for both copies of said second biallelic masker present in the genome; and (c) applying a haplotype determination method to the identities of the nucleotides determined in steps (a) and (b) to obtain an estimate of said frequency;

wherein said eicosanoid-related biallelic marker or said 12-lipoxygenase-related (12-LO-related) biallelic marker is found in SEQ ID No. 651.

11. The method according to claim 4, wherein said haplotype determination method is selected from the group consisting of asymmetric PCR amplification, double PCR amplification of specific alleles, the Clark method, and an expectation maximization algorithm.

12. A method of detecting an association between a haplotype and a phenotype, comprising the steps of:

(a) estimating the frequency of at least one haplotype in an affected population according to the method of claim 10;

(b) estimating the frequency of said haplotype in a control population according to the method of claim 10; and (c) determining whether a statistically significant association exists between said haplotype and said phenotype.

13. The method according to claim 12, wherein said control population is either a trait negative population or a random population.

* * * * *

UNITED STATES PATENT AND TRADEMARK OFFICE
CERTIFICATE OF CORRECTION

PATENT NO. : 6,794,143 B2
DATED : September 21, 2004
INVENTOR(S) : Marta Blumenfeld et al.

It is certified that error appears in the above-identified patent and that said Letters Patent is hereby corrected as shown below:

Column 22,
Line 39, "$10^{4-106}$" should read -- $10^4$-$10^6$ --.

Column 28,
Line 51, "Table 8" should read -- Table 10 --.

Column 64,
Line 36, "SEQ 25 ID No. 654" should read -- SEQ ID No. 654 --.

Column 89,
Line 52, "θ4=—=frequency" should read -- θ4= - - = frequency --.
Line 54, "θ3=—+frequency" should read -- θ3= – + = frequency --.
Line 56, "θ2=+—=frequency" should read -- θ2= + – = frequency --.

Column 90,
Line 28, "$D'_{aiaj}$ $D_{aiaj}$/max(-pr($b_i$)·pr($a_j$),-pr($a_i$)·pr($b_j$)) with $D_{aiaj}$>0" should read
-- $D'_{aiaj}$=$D_{aiaj}$/max(pr($b_i$)•pr($a_j$), pr($a_i$)•pr($b_j$)) with $D_{aiaj}$>0 --.

Column 96,
Line 16, "72418" should read -- 72-418 --.
Line 35, "10-347-220, 10-349-224" should read
-- 10-347-220, 10-349-97, 10-349-224 --.
Lines 48-49, "10-347-165, 10-347-220" should read
-- 10-347-165, 10-347-203, 10-347-220 --.

Column 100,
Line 4, "are id introduced" should read -- are introduced --.

Column 104,
Line 32, "Discover molecular" should read -- Discover (Molecular --.

Column 108,
Lines 9-10, "Discriminatory Potential of Biallelic Marker Typing Calculating Discriminatory Potential" should read
-- Discriminatory Potential of Biallelic Marker Typing
Calculating discriminatory potential --.
Line 44, "S is not P (event C)" should read -- S is not P (event $\overline{C}$ ) --.

UNITED STATES PATENT AND TRADEMARK OFFICE
CERTIFICATE OF CORRECTION

PATENT NO. : 6,794,143 B2
DATED : September 21, 2004
INVENTOR(S) : Marta Blumenfeld et al.

It is certified that error appears in the above-identified patent and that said Letters Patent is hereby corrected as shown below:

Column 110,
Line 20, "frequencies $P_i$" should read -- frequencies $p_i$ --.

Column 111,
Line 26, "HGBase http://hgbase.cgr.ki.se/)." should read
-- HGBase (http://hgbase.cgr.ki.se/). --.

Column 113,
Line 66, "(200 MM Tris-HCl" should read -- (200 mM Tris-HCl --.

Column 114,
Line 13, "5 see" should read -- 5 sec --
Line 67, "show association" should read -- showed weak association --.

Column 116,
Lines 47-48, "10-346-141, 10-347-165" should read
-- 10-346-141,10-347-111, 10-347-165 --.

Column 118,
Lines 35-36, "10-346-141, 10-347-165" should read
-- 10-346-141,10-347-111, 10-347-165 --.

Columns 209-210,
Table 18A, p value row for Markers Protein 12-LO 12-223/207 column, "7.52e-01" should read -- 7.52e-01 --.

Column 211,
Table 18B, Haplotype 1 row "2.1    8.3    [0/100]" should read
                          -- 2.2    8.3    [0/100] --.

Columns 217-218,
Table 20A, Test Hardy Weinberg controls row for Markers Protein 12-LO 10-349/97 column, "0.000 (HWE)" should read -- 0.004 (HWE) --.

Columns 223-224,
Table 22, "ALT+ vs ALT-    86 vs 194    0.123    0.144" should read
-- ALT+ vs ALT-    86 vs 194    0123    0.114 --.

UNITED STATES PATENT AND TRADEMARK OFFICE
CERTIFICATE OF CORRECTION

PATENT NO. : 6,794,143 B2
DATED : September 21, 2004
INVENTOR(S) : Marta Blumenfeld et al.

It is certified that error appears in the above-identified patent and that said Letters Patent is hereby corrected as shown below:

Column 223,
Line 54, "mark" should read -- marker --.

Column 226,
Line 4, "masker" should read -- marker --.

Signed and Sealed this

Nineteenth Day of July, 2005

JON W. DUDAS
*Director of the United States Patent and Trademark Office*